United States Patent 11,118,177 (MATERIALS AND METHODS FOR TREATMENT OF USHER SYNDROME TYPE 2A AND/OR NON-SYNDROMIC AUTOSOMAL RECESSIVE RETINITIS PIGMENTOSA (ARRP)) - sequence listing, part 2

SEQ ID NO: 5266 - DNA, 800503 bp, Homo sapiens
tgtttgctctgcagaatactttacctgggcacccaagtcttccttccagcattcctgctgctacagcctatttgctgagtaaccaggggttacagcagcgttgccaggcaacgagggacagcggtcctgttgaagagccatttgtcacactgaggggactggttgaaatgcaataaagaaatggtaactcagcttatttatcaatacaattacttgcacagtattagggatccatgtgtaacctacaaattcatagtcatatgaggaaacacagaaacattttgctaaatattaaagcataggacagacagatggtgttgggtttctaatcagctttactctgagcttaaagttgctgcacatgctgggataaggggaaaggcccaaagtcctttgccagctttattttgggcatctgtaagttagctctgggttacaatgtacagtgcatgtgtaaagaaaatctacaagattcttttccctgttaagtagagctggtaatgccattgctaattccctggggtgaagtaacaacacaaaattattgtatgtgtaatatattattaataattatatatatataaaacacacacatatattatataaatatttatgtataactggttataaatattactggttgtcctgtggacttataaagtgcttgatttgcccaatgcaatcaagagatttaccaaaaggatgagtattttactctgagcactgtgcttcaaaatgttttttgagaagttcagtagtgttgcttctaggagctcaaagtcctcaggcctgggatgagcttcagttttaaaggtgcagcagctttcccttgacgccctacgtttttgattcccagataccagcagctactcatgtcttcgccattgctaagaacgtcgttggtattaccttactctgagaacgtgtctgcagtttccagaaaatggagtatcgcaacatcacttaaagtaccctgcttcaaagtattgctggcaagtggcgtgggcctgattatttatttagaaatgctttatcaggaggagaatgcttttttgtaaacatgaattgcccagttctttcattgggctctggcttcttgtttcaggtcattgaaatgttgatctttgcctattttgcttcaatatccttgactgagtcacgaggtcttttcccaaggctggagaacgtgggagctttcaagaaagtttccatcgtgccaacccaagcagtatgtggactcccagaccgaagcactttttgtcacagctctgctgctgctgaaagtattcagttctgtacccagcggttttgtattcaggattgcccatacagatcttcacaccctacctacactgcccttttctcagcaggcctcagtagctgcatcacaccagacaagaatgatctgcatcctaacgcccatagcaattctgcaagttttatttttggaaatcacaagagctgcttttcttctcctccttctccaaagctgatggcatcatttaccttagctgtatggctgaaacctgagcaacaaggtgtaatgtaagtagtagtgtaggtataagctttcataggtccccaaaaccagtagtagtgaagatcatttcagcctgaattccaaaccggaagtgaaggctatatagaattcatggtattgaagactaactcttccagttgtttccccaattaaaatttttttctcttctatggatgaaatggaccatgaaaaaaaatgtgaaaatagtttatcaaaggcaaatgtgtttatgcaggaatcatttattttctatagcttagcgcgacctttggtcttagccttcaaagcctaaagaagactcagagtgagttttaaggcatggaaacttgtaattaatacaaataattaatattttcaaaatcttgaactgggtttatataatcaacatttccttactagggtataacattttcattaggcagatagttctcccagtccttgggactgttttcttcatcctcgtttccccaagaagagctgtttgtttgactcatggaagatgttcagtaatataaattgaatatataaataaccctccatctctaaaaacatatagcttttagttctttatcttgtggtattttcattttccaattagttaggaaatatgtaggtaagtgtgagagattctcaaaagctttcatgctgttcatcccagagaaatgccttcaatgagtctgggtcttattactgccattttttgttatttaatcaccagtttttcattctgtaatcttttctcaagctgatatctaatgagtttcttctaaatatttattgccaacctggagattttaatatacaggacagttttgaggaatttttgcttatcttttttcttcctagagggcttttggccctttctcttgtgacattttctgtgtgtgacagcgttggctggatatctaaaaacttgtgaaacaaaccagaaaaggattacaatctcataagcaaataggacttaaatgtttttggtgtttagtttcaatttgccaagtgaaagttggcatgtcttcattttgttttaaatttggattaatcacaaaattaatcacaaaccattcccatttctacatctctcctcaaagaaaaccttgttttcttactgtttgaaattctagtaaattcaagctactcagtttatataattaacatctgaagagtcttaaaacattgtcttttgacaaatagggctaagataaaatatccttctgagcttgtagggacatatctgtaccaaattcatcttctattgacatcattttgtataaataagacagagaagtatttacagggttggaagaacatggttaatggttttgagagttccttgtatcaaggtcgtttccattttcaaaattaaaatacctttgggaattgggggaatttcggggtgtttgcactagataagtaaaacaaacaaaacatggattatccaattattgtttattcaggagcagaataaatccagttcctaaatattttgctacctgccttcctctcacatttattatctaccaaagctagtatgtttacaagcaaacaaaatagcaaggaagataatcaataacatattaagaaatgcattttcagtaagcttgggaaaataagtctgcatttggtaaatacattcttgagtaatggtcgaattctcacttgtagatttaaacagaagaaaaatgaataggggcaaactcttttcaggttaagacctgatgggtagggataaaaacaaattcacttcagtaaattagaaatattcaactactgaagggttaaaaatataatttgcagtagaatttatataaaacttttatttctacttatataaaacctttatgtcatctaaatctatttgcctaaattaaaaatatacttgcactcataactttataccaaatatacatacaaaatatagtaaaattgtgacagtaaatgagggactattagtgttttacaatcttattcttacctcccaactcaggaaaaaaatagatgcaagtgatagatgcaagtgagaagaaattatgtgtgaaaaacatgccctttaaggaaagctttaaaccatctttagcagtaattcttgattggctcaattttatacatttgcctctctgatacttcctaccaaatttgatcacaaactcatcattttttgagagactactgtatcctaggtgtttgtgtgtgtatcctcagaatactcatgatctaaatgatctaatggagtgtacagatggatgagtgttattacctaggcagcacagtgtgttaagtgagcacaaagtgagacccctcaaccgaccctgagcaggaagaagggtgccaggaccaagcataatcattcagataccaaagctaagtaggaggtaaccaggtgaagaagagacctcaaggtctgaaaggtgtgtcactctaataagggtagagataacttaaaataatttgataactgccctgacacaagacctggaagttttctgaaaactcttctagtttttcaaaatcttatttcactgtgttctagaaggctgaaggacctttcacctcagatatttaacatgatctcagtacctcagttggactgtacggtcatggagaggtagccagtcatcttacagacactggctttggctttgtgccagttgatgatggggtgagtagagactatagctgtccattcttcatttcaccatgggaattaaatagagtgattctgacttcagggctaccaatttagagccttccatggacactaaatttgctttacattaaaaaaaaatttttgcactgatgacttaatactcaagcggcctgtagtgtgttgtaccacttcctctaaaagaaatagcaggagaactaatgagccaataacctaaatgttagttttgcagaatgattcaaccactttagtttccatcatgaatctctaatgaagggtgctgaggctctggggaatatattgtaaataagaattctattttttattgaaataaaggggcttcttcattggaataaagctttcattgaatataatgacattcaggcacttattcatagtacaccattttgagcaaagtttgaggtcattttaacaccactgtaactgcacaataccttagcatgtctttttggttggatgctgaccttttctctcttttccggttgcttcctaaggtgtgttatagaaaagacagtagatgggcagattgtgttcaaacttacaatatctgagaaagagaccatgttttattatcgcacagtaaatggtttgcaacctccaataaaagtaatgacactggggagaattcttgtgaagaaatggattcatcttagtgtgcaggtgagtaaaataaaaaatatttaacatttggttaaacacaaggatttgtcttcctttctctcttttaaatggcatctactcacaaaatctgcagcagtatcttttagatttcaggtgtgtataaatgacaactaaagaagaaaaatatttaaatgacctaatgatgtatctcttgatatactagcatttcctcccccaaaattgctgtaaaagctctcacagaaacttaaagacaatgctatctgtaattgtaatatcctcagaaaatttttgttttcttgggttcgtatattctattttgtttaaaaatgtgtaagggctcatttgatgtctggtactaattttactagtcatggatgtattaataccccagcttgatttttacatctgtctttctcagcagctgatgatgtgaataaaatttgtctgttgcattaaaatggtgaccttagaactaatgaactttacacttgaggcactcaaaaggtgttatattattattttagttgtcaaccacagtttgtatgagccttagaagctgctaaaggctgagagagctgtgacatgtctggtatttacagtctccagaagagaggcacagttcatccttttgttttttcagggcactggaatggcccaatacagttaaagccacacctgcctttcaaaccaggtgtattagtccattcttccactactataaaaaataccggagactgggtaatttattataaagaaaagaggttcaattggctcatggttctgtgggctatacaggaagcatgattctggcatctgctcagcttctggggagaccttagaaaacttacaatcacggcagcagacaaaggctgagcaagcacttcatgtggccagaatagggaggaaaagaaagaaagggaggtacttcacacttttaaaccaccagatctcatgagaattctatcaggagactagcactaggtggatggtgttaaagtactgatgagaaaacgtctacatgttccaataacctcccatcaggccccaccaccaaagctggggattacaattggacatgaggtttgggtggggacacagagccaaatcatgtaacttggggtgctgggtaccacagtttccagtatgagctctcatatgagcatccatccagtggctcatgtgaacctcatttgaactagaggacatttacatccttgttcattttataaaaattatctttgatttctcacttttttttttttttttaatcttgaagcagataatgagtgtgcgtcctcagagggtcttgataattgttcattgttttggctttcagatactaagatatgagtttagcaaatgtgattggcaggggtcagagttttcatacacaactagggttgaaatgatacacaaaggggacgtcatgtctgacgtcaagccttgtgcataggacatgatggtttctgattctcaatgcttattctccatgtgttcagtagttaacagataggagaccaatttgtcctagtcttgaagtttccattgtcttgaagtctccattctgcccactgaccagtcctacagaattgggttttaatattaaaaacgtagaaatagaaacttttaaagacagtgccatctttgcagaagatgccaaatagatatgtttgttgcatatttttgtatcaacaatgacaaaaaaattatctttacttgcctttattttgtgttatctgtgaaactgtgccatgttttggcaggcagtagtacattaaaagcttcacaaagaaagtttaaaatctaaatgcagagcggtaaccatgactgaattactcccttggggataaaatgctcttagagtgcctactgaaatcagcattatcatttcaatacatgtcaaatatgagtcatttactagtttaggcaaaatttcttcatgaatctttaaatctttctcttctttcaagaaaaggttaaagtacttatgatttaatgagactgctttatttcataactgtttgactatcaagagaaaacttgtccttttcgatttgtacactcttttatttatttttttgcataagttttaaactattctgcattttatattaaaactacagaactaggcagtcacaaaatgttagaaaaccattcagatctgtcatttaatcatctagcacttattaaatatttgaggggtatgcagcattatgggaatctggatttattcaaatgaaaattaaagagcaattatttactctaaaatggagctctatataaggttcctttatattggacaacagtctgaatatgtttaaggtattatgaaatttataaaaatccatattatagatttttttttgagacagagtttctcccttgttgcccaggctggagtgcaatggcatgatcttggctcactgcaacctccgtctcctgagttcaagagattatcctgcctcagcctcccaagtagctgagattacaggtgcctacaaccacactggctaattttttgtatttttagtagagaaggagtttcaccattgttggccaggctggtctcgaattcctgacctcaggtgatccacctgccttggcctcccaaagtgatggtattacaggcatgagccagagtgcccagcctagattttgaaaaaggaatgtactgattactcaaaagttgttataagaaataatggaggccaggcgcagtggttcatgcctgtaatcccagcattttgggaggtagaagtgaacggatagctcgaaccaggagttcgaggccagcctgggcaacatggcaaaacctcatctctacgaaaaaacaccctaaaaaaattagccaggtgtgatggtgcgtgtctgtagacccagctactcaggaggttggggctaaagtgaaaagatcacctaagcctggaagtcaaggcttcagtgacccatgatcatgccactgcattccagcctgggcgaaagagcaagatcctgtctgaaaaaaaaaaaaaaaaaaaaaaaaagtgacaggaaggacaggagattaggagttgggaaatctgatttaggttatgctactctgtagtcttaagaataaaatttataggaatccatatgatagttgtttaataaggaatgtactaattgcttaaacgttgttataagaagtaatggaagctgggcacagtggctcacacctataccctgcccgccttgacgtctcaaactgagtcatttgactcagttttcctatttacataagaagattgaactagatgaacaaaatgagggccttttgaattcttcataaacaagtaagtggagtgtggagtgtagcacaagtcattaaagtatggcaagctgttgagttgtgtagggttatttaggtagtaagtgacagagccagccccattaaccaatgatcagtcttgtgctttttttctcttctcccatgctgcttggcatttacataaaaacatttttttgctagattttctggacaaaatatagagaaatgtagattgttactattccattgtataactgcaagaacatttccagaaaaaatattttagtataaaatgtaacttactgttgcatgattatataatgcatctaaactccatttaatttggggattagggacttttatcatgctgggcataggacagaacaaatgattaataatcttgtttagtcaagtttcaaactacaaacctgcactttatgtatatgtggattttcacccatcttccaaatggccacaaattgatgaatttatatagtgtgtgtgtttctgtgcatgtgaaaaaataaaacatacaactctattcgtggaatggcccagaaaccagaattttagttcgttgcttatagtgattttttactggttagcttatacctggtggcataaaattaattagcagatctcaacttatgctttatctcagacagttcacttgtatcagctttccatcagtaaaatcagaattctaatttaccaaaatcagaaaaaaaattattttaaataattaaatatctgggggaaaagatgtcaggaaatccagacataccaaaattggaaatcgaatttcctaaacaaacaaatagacaatatgctcaatattgctatggtaatgaatctcacagcttttattccaaaactagcattttaaagtgtcaatctgttggaaaatgattagtgtttaaattaatattcatttatggacttgaatctgacaggattgccaattgaaattttactttggggtttaatatattggctatttcaaattatatcaagctaaaattcattgtgtcattttttatactaaaactagaaaaaatcaattcatagtttttattatcatatagggaacactgatcatattagcaaaatttttaaagcttagttttcatattaaatcagcacatgctgtagttataagatttcctttggttactcttataaaagttttgaaatatgtaaaaaaatttactttagcatttcgttatggattggtaggtaaaacaatatggaaataagtatatgtgtttagtggcatttcatttaaaagtaaaactttagggttttctttgacaatatattttgccttaagcagttccacacattttatagcccaaatagtgtcaaagaatcatcagtatagtcatccttctagtaattatgcagaattgcagtaaaacaattactacgatttgaagctgatgaaatactacagctgtggaaccaagaaatgatttagcattgggcttgttcacattttctatgctattttcagggctccttgatacattgacaattcaagagccatagatgactctagctacaatagtgtgaaaaagagcagttctaatatgatacaatgaagaaaaaaatgcatgggtaaataaagttttaggaatcaatatatgaaggataggagtttcataatcacagttcatgaagtatgctcttttgatttatgtattcaatctaagaaagaaaaactattgatagttctggaggaaaacaaaatgcaatttaaccaacatttgttagaatagataaaccaagtctctcaattaatctctgaactgtatgcccatgtgcacactttataaaggtgtttccatgttcctattgattgagggaacataaaacatccatgtcaccttatggaagcctcctcattcagttcagtaagctttatggcatagaattgtcataggaataccatcccagccccactcccattctaagagaatctcaacccatattatttctttaatatatcattgcatttagctctgactctgtgtgtgtgtgtatgtgtgtgtaagtatgcatgcatatgtgtgctaaatgtttctttgtgcaaagccttctctttatatctagccagctgggttaacagctcaagttagttgaatagttttgggttattcaaaataaattaagatcaatagaatataatgaagtttttcagaacaatcagttacaaattatcatagctgctattaatcattgatttatgtgcactatattaaacatgttacatatttgcagttatacaatgaaatagtgacatgcttgtaacatgtttaatatagtgttaataatagctctgtgccactgacttatattatctccatgacagagattttaaaaaattagccttaggaaatttaaactacctgcctacatttatagtcccaagcttctctgaccttaaactaaaagtaataacttgccatgaacatgggtcactgagcagatctaaataatagtttttaaaattctccaaaccaaaaaaaaaaggcacagaatcccaaaagaactgaaaacatatatttataatgtaaatataattttgtatatttatacatatttgtaatataaatattttcaatgcttcagatatttacatgatttatacaaataattaaagtcaatatattttttaactatacccctcattgatacaagcaatttaaatgtacaacagaatgtaattttgtataaagttctgcgcaatattttcatgttttatggcagttgcgatagactacaatggcttaaagaaagaatatttcccttaagccagcctgatcacctgacccatgccttatagaatcaacccttattacaataaaatacaaagaaggaagcacttcctactttattatggaagaggtaaaaccatccaagtaaaaaagtaattattctctgtacgttttttgcatgtgattttaaaatgcaatatttaagcagaaggcaaggctttaattcttgaccttttagtaaaaaattgtgcaaccctgggaaaactatgtaactcctcaaaatgttaggatacccattacaaattggaaacaaacaaacttggcctatttagcttacaccataaatttgaacatataaagaaaatattgtctactaaaacactttatagcctataacttcctgctatgaaggagcttacagtctcttcagaggataagcaatcaaataattacacaaataaaggcaaaattataattgtggtaagtgctacatgatcacatgaagaatgatttggtcaaaccactgaagtcaagaaaagcttccttgagtaaatgttattgaatatgtgtattagttttctaggcctgtactaaaaaattatcacaaactggtggcttaacacaacagttaattcattgttgaagagttctggaggctagaaagctgaaatcaagttgttagaagggccatgctctttctgaaacctctagaatccttccttgtctcttccagcatctggtgtttgcacagacaccagagtatgtgattgtgctacctcctggggtttgtctgcccacagcaaggccgggaacccagaaaagaaaagaggagtgcccagtgtagccaccacccactgcatgagaaacagagctggcagcaatccttgatgctccttagcttgtagctacatcactccagcctctgtctgcattatcatatggtcctctcctctgatcgtgtgtgtcttctcttcttataaggacatcagttgtactggattaggattcttcctaattcggtaggactcatcttaacaattacatccaaaaagacactacccaaataaggtcagagtcacaggcacatagggttagggcttcagtatgacttttgatgggacacagttcaactgatagtaagatttattcaaaagaatgcataggatccaactgggcaaagagaattgataagaacattccataaatgcatagcaaatagtgtaaatgcccttgtataaaaagaaatatgttacatagactaaaaaaccaaagtggttagagtgtcgctggcaaagtgggacatggtgtgaaatgaggacagaacagtaggaagaggctatgtgttaaagagaatcactggatatgttaagattttttttttaaatggaactctattgaactgttttatgtgaaggacaggagatgagggatgaggataaggaaggaaaacgtatgatatgcacagattattttttcctaaagatcactttggctgcagtgagggagaatggtttgcttgaagacaagtgtgaagggttgttatggtattttcatggaccaagtcagatgtaagtgttacttacttacagcatgaagacaatagtgaatatgcaaatgaatggtcagctttgagaggagtttaagaattaaattaaagggcttgttgatgaaggaatatgtaatatgagggaaagggagttgatgaatcccagctttctggcttatgtaattgcaggtacagtgatttctttttctcaaatagaaatactggaagagaatcagattttggatgtggagcacatatgaattagattccagtttagggtaataattctcaactatagaaattattagcattattgagaaactttaaaaaatattctgatgtccatatccctttatgtcttcattggtctaggtggggcgcaggcattatttctttctttcttccttccctgatggatttaaaaaggtgtaacaaaagaaaatatcagtctaccattgatgagcatttaggttggttccatatctttgctattgtgaacagtgctgcaacgaatatacatgtgcatgcgtctttatgatagaatgactcagattcctttggatatatacgcaggaatggaattgctgggtataatggtagttctgttttttttggtctttgaggaattgtcacactgttttctgtaatggttgaagtaatttacactcccaacatcagcctattaagcattcctttttctctgcaacctcactagcactgttgtttcttgactttttaataacagacattctgactgatgtgagatggtatctttcattgtggttttgattgacattgctctgatgatcagcgatcatatgcttgttggccacatgtatgtcttcttttgaaaagggtctatttatgtcctttgcccactttttaatagggttgtttttttcttgtagatttgttgaagtttgttatagaggccagctatcagacctttgccagatgtatagtttgcaaaacttttctctcactctataggttatctgttcactctgttgatagttcgttttgctgtgcagaagctctttaatttaatttgatcccatttgtcattgcttttggcatctctgtcgtgaaatctttgcctgttcctatttcctatgtccagaatgctattgcctagattgtctttcaggcttttagttttgggttttacgtttaagtctttattccaacttgagttgatttttatatatggtataaggaaggggtccagtttcaatcttctgcatatggctagccagttatcccaacatttattgaatagggagtcctttccccattgcttgtttttgtcagctttctcaaagatcagatggtggtaggtgtgatggccttatttctgggctctctattctttttcttcggtctatgtgtctgtttttgtaccagattcatgctgttttgcttactgtagccctgtagtatagtttgcagtcaagtaatgcaatgcctccacctttgttatttttgtgtaggattctctgtctatttgggctcatttttggttttatatgaatttaaaaagtttttttctagttattccaagaatgtcgttgtttgtttgatagaaatagcactgaatctgtaaattgctttgggcaatatggccattttaacgatattggtccttcctattcatgagcatggaatgtcacacaaaccaatgatatctgtttgtgtcatctctgatttatttgagcagtgctttgcatttctcattgtacagatctttcccctccctggttaactgtattcctggtattttattctttttgtggcgattgtttcacctgcttctaatcaaatctatttagtagctgttattaaactgtgtagccattagtatacagtagtactccattacccttggctttgctttctgttgtttgtcacccacagtcaaccacagtctgaaaatatcaaatggaaaatttcagaagtaaacaattcataagttttaaattgggtgctgttctgtgtagtgtgatgacatgtgaggtggtcaccatacctcctgcctgggaggtgaagcatccctttgtccagcagcttctccatattgtctatgctcctagcccttcagtcacatagtagctctcttagtaatcagatcagctgttgctgtatcacagttgtaacttgtgttcaaggaaactgtatttcacttcttaatggccccaaagtgcaataatagtaatgctggcaatttggctatgccaagaagccataaagtccctcttttaagtgaaaaggtaaacactctcaacttaacaaatgaaagagaaaagatcatatgctgaaattactaagaacttcagtgtaagaatgtatcttctgtccatgaaattctgaacaatgtattgttataattattctattttgatagttattgttaatctcttactgggcctaatttataaaaattaaactttatcttgggtatgtatgtataggaaaaaacatagcatatattgggttcagtaatatccacggtttcaggcattcactgggagtcttgcaacatatcctcaatggataaagggggactactgtatgcgcaatatatgtatacgcttaaaaagagttttgtttagctagtgtgtgtaagaagattatcacaagtcacactgtagtgtttgccttttgccagtctgaatgttatcatcagtctaatattttatagcaaagatttaagttcattgaaaacttccctatggaaacacttccaatcaagacctacagcaagccatgaataaattaacatttaaacatgaaaactgatatttgaagaagaattagcaattaataatttctgctagaaaatggtggtttctcagccaatagctataaattgtataatatatgtaaaaggaaatatatacaaatatcatatgggacatatatcacatatactactaaaattgaaaattgctataaatagaagactatgttccaatgtccactgatttttttttttttaacaatctctagtcttgaaaatgccactatggtaattctgtcaaatttgtaatggttgggatttgatggtagtgcttttgaaacctgtattatctaatggaattgtcatttatattatatcattttcacctaaaagccaaatacaataagacttaaattatttttgctttttttgtggatagtcatttttgtgcccaaagggctaactgatgccttcagttatacatgaacaattcgcactaacgtcaggaagaacagtgtgcatataacctagggcagaatttggtctatggaatgtatcactcagtagtggaatggagattatgactttatttaaacatggacttgagtagttttatttttccttactgtttcccttggcatttctttctctaaagtgcaacattcaaaagtattctatgcagctgtagtgtcctggatgcataataagggcatatgttcaaggcaagtttaaatatccacataagccaaagacagagtaattaacattaaaaaaattaagacaacttttccaagaatgaaaagctttaatagattagctaattttagaattatttaacaacaactgtgaaaaattattagtatttacaaatatgtatatataaatatatgtaatgtcttatgttagacagcaatttcattctgctctctaatgattacatgacatacttctgaaaaaagtcaaacagtgtgttctagaaggacaaagaaataattggttcagttttgcttatacttagtgttcaattgttatcaacctggggtgggaggaagggaaagaaagagggaaggacagaagagagcaagaaaagaaggaaggaggagaggaaggagagatggaagtcatgtgacatagctagggatttggggcaaaattcaagacccatgttttccttgatggaaagccaaggaacctgagaaggagagtcagcccatgccaatttcactgtggtagaggtgaccaagaaagtttacattatggatgtatagtaggtaattttaggttgtttttgtctgggatataaacccattgtgttattccagttatttggccaaaatgttccatgcaaccattttggagtgctagcactttagggaatttataaaaaggggtggtgttcagtgtctgggttgaatacaaggtaggtagaaaaggacaatcaaaggaattagctgcaaatgagatgaaatctatgggaacatatattgagaaaactagtgaccattataatttaatcctctgaaatacctgcaacaatctgagaacaaggtaggtggcaagatgcatttataaatattaaagaaacacaagaccccatacactttgaaaactggggagtaccgaacttggagaggtctagtataggtagtgcttgttggtttgcatatttttaaaaccactttattgaggtctgattgacatagaaaagtctgtccatgttgcatgtatgcaacttaatgagtctaaagataaatatatgcccatgaaagtatcaccataatctgtggcataaacatatccacctatttgtttattcttaattaaactttttcctgagataattgtaggttcacaggcacttgtgagaaataatacagaagtcccatgtaccctttactcatttgttctcatcagtaacatcttttataactatggtacaatattacgaccaggatatggacattaatataaccaatattattcacatttcccatttttcatatattcctatgtgtatatgtttagatccatatgattttattaaaattttatccaccacagccgagttgcagaaaagttccatccctacaaggacacctcaagctgcctttttataaccatgcccactgtctcccttcccctactgctgccacaggtgtccctaacttctggcaaccactcacttgtactctatttctaaaatttggtcttttcaaaatgttgtatacatgacatcacacaatatgtactcttttgggattgtttctttcttttttactcaacataattccgtggggattcattcaagttgttaagggcattgatagtccaccttattgcagcatagcattccacggtatgtgggtaccatggtttgtttaacccttcacccattgaaggacatctaggttaattctagttttgggttgtatcaaacacagttaaagcattcgtgtggatgtttttgttaacatacatattcgtttctctggaataaatgctcaagagtgcaatagcgtatggcagttgcatgtgtgtgttttaagaaactcatttccagagtggctgttccattttagaatcccaccagtgatgtatgagtgctccagattgtgcacatcctttgtagcatttaaaataaaggctacatttattttactatttaaaataacattttagccattctgatagataatatatcactgtggttttattttgcatttctttaatgactaatggtgttcagcatattttcatgtgcttatttaccattcatatgtccaattcggtgatgtctccccatgtcttctgcccattttctaatttgattgcttatttgtagcttgctgtttttattctttttacagggttttgctgagattgattaggtccaatttatcaatctttcctcttatgtattgtgttttccatgtcaagtctatgaagtcttgcctaaccctaaatcctgagtattttttctaaaagattttttttattttatattgttaaatttaagtatgtgtttcaggccaggcatggtggctcatgcctgtaatccccacacgtcaggatgctgaggtgggtgaattgcttgagcccaggacttcgagaccagcctgggcaccttgtctttacgaaaaattggctgggcatggtgctgtgtgtctgtagttccacctatgggggaggctgaggtgggagaatcagttgagctctggagtttgagaccagcctgggcaccttttctttacaaaacattggctgggcatggtgctgtgtgtctgtagttccacctatgggggaggctgaggtgggagaatcagttgagctctggagtttgagaccagcctgggcaacttggtgaaacctcgtctctactaaaaatacaaaaacaattagccaggcatagtggagtgcacctgtagtcccaactgctcaggagctgaggaaggaagatcacctgacctcaggaagttgaggctgctgtgagcagagatcatgccactgcactccagcctgggcaacagagtgagaccctgtcttaaaaaaaaaaaaaaaaaaaaagcctatgtttcactttgagttaatatttttttaaggtgtgagatttggttttgagcagtggatgtccaaatagcccttagttgaaaaggctatatccttccttcactgaattgctttggcacatttgtcaaaaattagtagaagatatttatgttgatttatttcagaattctatgtatatccttccaccaattccacatgttcttgagtactgtgagctataatatctagtagagcgactccttctactttatcctgctatttcaattacaaaaaataataaaccttttagggcctatgattttccatataaatttcacaataagcttgttgatgttttcaaaatatcttgtttagattttgataggaattgcattatatctatagatggatttggagtgatttgaaatcttttactatattgagtcctctaatatataaacatggtgtaagtatcaccatttaggtcctcttttattggcattttgtaatttttagcacatacattgtattagtctgttctcaccctgctataaagatactaccagagactgggtaatttataaagaaaagaggtttaattgacttggtttcacatggctggggaggcctcaggaaacttacaatcatggtggaaggtgaagggaaagcaaggaccttcctcacgtggcgtcaggagagagaagagtgaggtgtgaaggggaaagatccccttattaagccatcagatctcgtgagaactcactcactatcatgagaacagcatgtgggaaactgcccccatgatctaatcacctcccgccaggtgcctccctagacacgtggggattatggggattatacagttcaagatgatatttgggtggagacacagccaaactatatcatacatcctgcacctgttttgttgagcttacccataaagtgtttcattttctttttggtgattgtaattggttttgtgttttaaattttggcttctgcatgattattgttggtatatagcaatgttatgaattttctagggtgatcttgtatttcaaaactttgctgaactcacatttatagtagttctggaaattctttatttgttggaattttctacatagacaatcatgacatctgaatttggagcagtttttttaatctttccaatatgtagtttttatttctttttccttactgcagtgactagaatttttagtagtatgttgaataagaaaggtaagagcagagattcttgctcttcttgttcctaatcttaggaagaaaaagagttcaactttcaccattaagtatgatgttagctgtagattgtttgggtaagtgttctttatcaaattaatgaagttcctctctattcctaatttcttggagttttgagtattaaatattgtcacaaggcattttctgattcaattgatatgattatatgatttttcttctttagtctattaatgtggttgattacactgattgattttcaattgttgaaccaaccttacatacctgaaataaatcctacttggtcatagtatacaattatagtatatgtagtatacaattccttttatatagtgctgaattgatttgctcttctttctctagtttcttgaggtagaaacttaatgttttaagatccttcctcttttctcatataagtattagatttagcttagtgttgtaatttaatgtgtaatttaatttagtatttaatttagtttagtgcaataaatttccccttccacgctgctttagcagcatctgacatattttattatgttgtatgtttgactcttggacaaaatgagggcttggggtattgactcccgatggagttaaaaatttgcatttaacttttgaccaccccaaaatgtaactactaatagcctactgttgaatggaagccttaccaataagataaatggtccattaacacatattttgcatgttatatgttttacgtgctgtattcttataattaaatagagaaagaaaacattgttaagataattataaggaagataaatatatatttactattcattaagtgggagtggatcattatataagtcttcatgctcattattttcacattgagtaggctgaggaggaggagaaagaagggttggccttgttgtctcaggtggcaaaggcagaagaaaatttgtatataagtgaatctgtgtagttcaaacctgtgttgttcaaaggtcagctatattttcatgtgcattcagttctatgtttttgaaatttcctttgaggttttcaaaattttcttttacaactttctttttgactcatgggttatatagagatgtattgtttagtttcaaataaattggagattttaaatattataattctgttattgatttcaaatttgaatcattttcaatcagagaacacattcagtgtgaattcagttctttaacatttgttcaggattttttaacaggccagaatgtagtctatcttggtgaaagtttcacaagtatttgaaattaatgtgtatagtttgttttgtgtttacacacgcacacaaacacagatgcatacacatataaatcttctgttatctttttatttctatttaaagaacttcttttagtcattatttaagagtaggtgtgaagaaaaccaattctcttataaatagaactaagtacatctactttgtatacttttcttgagtgattctatattgtaatgatgtcctttttactagttctatcaattgctgagagtttgctgttgacgtccctgatttaattgtgggcttatctatttctcctttcagctgtatcagtcttgcttcatgcatgttaaagttctgttgttaggtgcatacatgtttaggatcattaggtctttctagtggagatatcattttatcattatgtaatgtccctcttaacctctagatatttggtttgttctgaaatctatgctatttgatagttactagttattccttttttcttttgattaatgtttgcagatatatttttctgattactaatttcaactgacctgtgttgatgtccatgaagtgaatgttgtacagatagcatattttttggatacttttttaaaaattaagtttatattctaatacactctgctaatctctgtcatttatttgtatatttagaccatttacatctgagattcttactgatatgctagccttatgtgtgcaattttattttttctatttcttgtctgttgtgggtctctgcatttctcttttctgaccttgctgtaggttacgtgaacacattttaggattctatcttggtgttttaacagcattttgggtatatcttttttgtatagtgtttttagtggctctaggtattaaagtatatgtaagtcacttatctactgacatggacatattactacttccattaaagtgtacttttatttccacttaggtcctttactcattctaccttttcagtataattgtcttaagtgtttcccctacatacagtgagcatcacattacactgagttgtaatttttgcttcaaccgtgaaatattatctagcaaactaataagagggaaagtctaacttatttccccctaattttattcattctgatattcttattttctttataagttctgaagcttttattatcattttgtttctatttaaagaacttcctttagtcatcctttaagaatgggtttgatgaaaacaaatactcttatttttcactcatctgagagtgtcttgatttttccttcattccgaaaggatatttttgctggatataaaatttatgattgacagttaattgctttcattacttgataaatgttgtgccactccttctggcttctaatttttcagatgagaaatctgttgtcatttgaactggtatttacttataagttttacatcattcctctggctgctttcaaggttttctctttgcttgttttgtatttagcagtttaatagtgaaagccctagcatgagtttccttggttttatcctattgtatgagatttgctcagcttcttgcatgtgtttgttaatgtcttttgccatattttcagtattttcagacattctttcttgaatacattttcactgccattctctcctcttattctaggattccagttatacaaatgttaactcttttgtttttaactcactggttcttgaagctctcttcaagtttttttttttccttttaatctctcttttcttatttgttcaaattaggtaaattcttttgatttccttcaggttcaggaatcctgtcatcttcctgttacccttgaacccatatagcaagtttgagtttgtttcaatggttgtatgtttcagttatttagtttccgtttggatcttttatatatatatatatatatataacttctatttctatgctggggtttctctcattttttttcttgcttgaaagaattcacaattgcttgttgatgcatttttattgtatctggtttaaaatccttgcctgataattccaacatatgattcatatcactgatggcatctgttgatcttcttctttcattcaagttgttattttgatggttcttagtatgacaagtgatttttattatatcctggatgttttgggtatcgtagtatgagactctggatccaaattcatcttctttttttattcagaagctgtccttacattgaggtgtgcacagaggccaggtgggtgtgtatgttcattcatcaccccgttgtcactgccaacatcatccagcagaagtggagcactgactcacactgcagcagatgggtagggtgaaacttcagcttccctgttgaccccttcccagtgaaagcgggccgcctattgctgctgccttgttgcccctcatggtgacatattcctaactccccactgagccacggaagggaaaaattcattgcttgttcacactactttgttgctgcagggtaggggtggaagctgagcttcctgctggtctctgtgacaccaggggaggtggggaatggagtgtcaagtaaccctcctcctatcaccttattctgcctcattgatgccaggtgtgagagaaggttctgcttctctccagaactctcccagttcttgtgaactgggtccaattcacaagaaagggaaaaaggatgtagagtattgattggccctaacacctagcacacagtctcactaataccactgggagtaggggctcagctcccctctaggccctgctcacttagtgagggtggggtgggaacagaatggagactaaccctgacacacaccacctcatgtggtcttgtgctgtgaagagagtggagaggttcattccctccttggtcccactgacaccagaggttggagtaaagtaaagtgctgatgagccctgactctcgtgtccttgtttagtcttgttaatattgggtggatgttgagcttcagctcctgactggggccctgccagagccggggggaatgtaatgtgctgactagtcctgccttgcaccacttcactaagtcttgctgctaccaggtaggggtggtggagatggtttagctacttgctgggctgaggtgacactaacttagtaaagagttggagcatggctgactcctttcagacaggggatgaaagatcagccctctgctcactctgccaatactatttagaaaagagaatcagagtggcacaacttccactgagcagaggacagaaaataagctccttatttggtctcatcaaaaccacccctacctacagttagacagctgcctgtttcaacaagtggagaatggaagatcagctctctgtttggtttattggaaccaccaggcaaggggaattggaacactgactgcttctgccagtgggaatagaaggttagctgcctcttggccctgtcaacaccactgtgaaagggaatcaaaaactactgcttacttctgttgggtgagagggtggggtgaaagattagctccctgatgagctcggctgctggaactatgaatgtgtgtgagtgtgtgtggggagagagtgtgtgtgtgtgtatgggtgtgcttgtgtgtgtgtgtttggtttttccattggagtttggctaaagtatgacaggtactttttgctaaaaaggttttctcttgtaggccaacattttcctgatcttctgtctaggaaaataagcctttccttggagcttattttgtctgtgcctgttggtggttctacgttagatgtttctggatattaaaacaacaacgaaaactagggaatttgccatgttgttcctcaagtcctcagattcctaattttttttcttctacctacttcgcaaagtcatcttacacttatttgttttgttatgttcagggctttttaattatagaaagagaactgggaggaataaggctgctccatctctgtcaggatcagaagtcatgtagtgttataaaaaggactttgtctaccattttaaaatagctgttggctgtaagctccttattgtatttaaagtatattggctaaaattgtgggaggtaaggaaaactctttgtaaagtgaactgacatggtgaaaagagagagaagatatgcttgtcaaatattgcgaagtctattcagatcaagctagacatggtctgtattagtcagggttctccagaagaaaagaaccaataggaggtgcatgtctgtgtgtgtatgaaaaggaatgtattagggagaatttgctcacatcattataaaggcaatgtcccacgacaggctgtcagcaagctatagaatgatagaagccactagtatgtctcccaaggaaggtgatactatgtctcagtccaagtcccaaagcttcaaaaccagggaagctgacagtgcatcccatagtctaaggctgaaagcctgagaacccccagatcccccagagaccactgctgcaagtttcagggtccaaaggctaaagaacctagagtctgatgtctaaaggcaggaggaagaaagggcattctgcactggaagagaaagagagaggcagctcacaaagcaagaaaagcctgcaagctgaatatcccccttcttctgtctgctttactgtagacacacctgcagctgattggatggtacccacctacattgagggtaggtctttctctcagtccactggcttatatgtcaatctcctctggaaacaccgcaatagatacatcaagaaacagtgctttaccagccatctaggtatccctcaatccagtcaaattaatattaaccatcacatggcctattcacaatttaaaaatgtagcataaattgcagcagtggtcaagtgtattggcaagttgtaaagtgcctataagaaacctatacacgagcatttgcagattcccttaacacttttcagcaaatattttgttacaattgaaattaaaaggcagtttgaaattgttcctctactaaatatcacactggatatgaataaaataactagatagactaacaaggtacatactttattgcctgtgattattgcaactaccactcctggtggagagccattcttctcaggtgtgcaagtggaagattaattctcaatcaggaatatagatttgatacaaggaaagcatttcacttggcattagtgtgtcaacatttcagctaatttgcctaaccacaaatacttcagggggaagagaaattgctagtgctttatattaaacattggatggagctggcggagataatacaatttgtactttttttacatagtttcaacgaattttggcagatatgtctttttgaggcaactttagatgttgaaaagctgcttgtggatattcaagacttgtctttttttcatgttacaatgaccatcaccatagtttgtatctgattttttttgtgtgaattgaggaatgtggagtcataatgcaaaagtcattgccataattctttgcagatcttatgactggaaattcttgtgtatgtagtttgatattcatttgtaacacatgtaactggttcgtgtaatgattaaaataataagtaatgcttgatcatggttaaaataaataccaaggataaattcttctattaattagtgtaagcttatcctaattaacatctttaattatgggctgttgttaatttttgtcgcaacctattagatatactgtcctaaatcattaacactagtgtaactgagcataaactctaggtgactcacggctacagtggaagcgcccatggaaaatatatatttctaagtacacagtttagataatttcaagcagaatcagaaaattcttgatgaattctaaatttagtataaacagaaatgtattaggtttggttattgagccaagcttcaaacattgaatatcagaattgtgtccatttgcaatgagtaagcatttgattcaagatttttttttgtactcagactcatttttgtatatctttctgtttaagtcatattgtatttactgcgattacagattttttacatatttcttaaactggttctatgttatgccattatataacaggtgataaggaatgtactgtcactgccccttgacaatgaaaaggggacatctctactagtgtatgtgtatgtagctgtggaggagttgaaacagtgtaagtgaaatgcctagaaattgtcctgagttttgattttgtttgtgcttacatttttattagtatatgtactttcttgaatagataattgatttggggcaatatttctcaatcttggcactactgacattttggactggataattattggttgtgcctggctttcctgtgcattgtaggatgttcagaagaatctctggtctctacccactagatgccagtagcaaacctgccacctctctgcctacttccgtcctgtcttgcaatagtcaaaaatgtctgcagacattgccaagtgtcccctaaggggcatgagccttggtggagagaaacttctttacagtctcatccttggcgatgtcatttccttataatttgcgtagttaaacatttttgttttgaggagcataagttgtgataccatacctgtacagaagaggcttggatttaaggttaaccacatttaactgagagaattttatcaaagcatgaaataagaaaaataggggcaaaaaatgaaattctaaaatggcttatgcaatttctaagggtagctaataagaattctgaattggtgacattgtttttaaaaaaagtaaagcattaaaagaatttcaaagataaaatatattttttggagtgtgaacactgtaattaaggagacccaataatgttaagttacttaaaggatgtatttttacttaaagtaggatacaagttggagaaattaacattcggttgattgttaaatattttgattcaaagaaagaacatagaattgtcagcctcaaaaaatatgcttaagatagaaaaataattttggttgcatgaaaagaaaaagattttagtaaattgttgacttgaaaaggggaactatttgacagaagtctcaacagtgttttggagtggcatagtgattggggggtgacatcagatgattagagttaaaaacgactggaccggctgggcgcggtggctcacgcctgtaatcccagcactttgggaggccgaggcggctggatcacaaggtcaggagagcgagaccatcctggctaacacggtgaaaacccgtctctactaaaaatacaaaaaattagccgggcgtggtggcgggcgcctgtagtcccagctacttgggaggctgaggcaggagaatggcgtgaacccgggaggcggagcttgcagtgagcggagatcgcgccactgcactccagcctgggcgacagagcgagactctgtctcaaaaaaaaaaaaaaaagactggaccagttattaggccttaagttgatgtaaactatatgacaaattgacaatttagagacattgtggggacatttctatgaaacgtctgtttattattcattcctgtgatgattttgaaagggcaaataaaatcataatcacatattgtataatgctttttgtctttcaaatacatatacattaaaaatgacttatataaagcaaaatgtacctttttgtgcacaattctattggtttttgtggatgtatactgttgcataaccaccatccaaccaatacacagaagagttctataacttcagaatattcctttgtgctactcttttatagtcattcccatcttcccatccccaccctctattgacccgtaaactgttttctgaataaatatctgggaaaaggattgctgtgccacatggtaggtgtatgtttaaagtttctcagaagttgacagactttttccacggtggctgtaccattttgccttctcaccagcaaaatgtcagattacagttgttttgcatcctggccagcacttggtatggccacttcatttatttatttagctcttcttctgataggtgtttagtggtatctcattatggttttaatttacacttctctaatgattgatgattttccccggtgactgatgatgattgaggatcttttcaggtgcttatttgcctcccatgtgtgtatcctctttagtgaaatgtttgttcaaatcttcccatttcaaaaaatgttggcccttttcttattatgaaatttctatggctctttatgtcttgtgcatagaagtcctctgtcaaacagatgtctgttttgcaaatattttcctgatttgtagcttgtcttctcaatattttaacagtgtcatttatagatcagaagtttccaattcttcaggtctggctcccctccataatctgtttgctttgattcacttttcagcatcctcatgtagttgctttttgtgtttggtctgagattttacttgtgattggcagggagagataggctgaacgtgactgagtggagtatagcatgagaagacttgcataatattttttttaattttcagtgttttgcaaacattatttttgatccattaataatgttaatgattgccattttatatacgagaaaataaaaaaatcaagagtcataagagtttaagttcataaataataaaaagccacatggaaataaccagtgatctaaatcacctggaacaactaaaaccttaaggtattatatcctagtttgtgtgttccgaccacaagcccctagaatgcaaattacttatgtaccttatttaattatgtttgctttacgtaattttagtactttaggaacttccttgattaaatttcaattcatacatttgctgaaaaataactaattttaaaactaagtaaggttattaagtaacttttttccatctggaggagaattgtttttgttccagattctttactgacacaatagtagcacactcgaataagtgcatagtatgcttcatggaagatcatgtgtaaaagccaggcttagtcaatgtttcttctgataatacatgtgaaaagttgaaaagaacctttatggtcattttcctagtaagcaagtcaattccttttgcttaaagcattttaacttcattaatgtaaaagacaatagatatctactatgtatacaacactttttaagagatcttgaggttacagaagatagtaaagccatggtgtctatccttaagaagctatacataataagaaagaaagaaatctcactgtgatattgagtatacatttttggaaagtaatttttgaataaaatcagatgttttaaaaaatcgtaaaaggttttgaatcaacattttcaaatatttagaaaataaatgagaaaaaagacagacccaaccaattccttccagtaattttgctctgatattaatgtaattcccttcagcttttatgtgcatattatatatgttattaaccatagtacatctttaaaacatatataattttgtctgctcacttttttttaaaaaaacagcattgtatcacagtttattttcatgtaccttcatagttcaaggtacaagggaagtaacagagattccctgagagaagacaatggatgttcctaagaaagacctagtgtgagagttcagggaactgctacactttggattttttttttttttttttttttttttgagacggagtcttgctctgtcatccaggctggagtgcagtggcacgatctcagctcactgcaagctctgcctcttggggtcatgccattctcctgcctcagcctcccgggactacaggcgcctgccaccatgcccggctaatttgttttgtatttttagtagagacagggtttcaccgtgttagtcaggatggtcgggatttcctgaccttgtgatccacctgcctcagcttcccaaagtgctgggattacaggtgtgagccaccacacctggccaggattggttttttaaaataatgtagaatgttttgtatttgtccttgcatcatgtaaagatttatccttaaaagtgcaatttgtctttggactataaactctgcgagggacaggacagtacttacatagcatgttaaaaattcaagtatcaatctacccatttaggtctattggctctttactgagtccagggttttatttacatgtatcactgaatgaatggccttaagaaggtacagatgagactactgaggcatagagagatttaacagaggcaagcagagcatcacaagcagtttggaactcaacacatgtttcttgtttgaaaatatgcacagacaaaagagggatggatagaaagttggttcaatataggattaagacctggaacaaaagcacatgggcaccagcagaatctacttgagaggtcacagcgcccaaggggaaacaaccctaggcaagtcacttaacctcactcaccttagttctcttgttggtaaaatgcagagtttatgcaaactcaatacatgtcaagaaatatctgcaaggcattgtttaaaattgaccctctggatttttttcatgcatgcctggttattatttattaagatgtactaggggcaagtctcaaatggaagaaaaaataaaaggcacatctgcaaagtgaagaagtggggttaagcgcaatgcaacagaaactcttatactaatccaggaggactttacctgtcaatcaaatctatattcattttttttaaagattaataatggtttgttaactgagtaagctggcagatggtaaagtaatgtgatgagatcttggggcatctatgaccagttgatgactgactgaccaatttcaaaagatgctatgaaggatcataaagtttagttccatgtggattttgatgatagttgcatctatatttaaagccttctgtcactggaagcactcttggtgttgtcagactgtctattggactggatgagctgcaacttctcgcaattgaatgtcaataagaccaaagcaattttggttgattcatagcaccagcttaagcatattcacttgcacagattacatttgacagatagttaccttcagctgaactctgtggttagaggcttgggcgtattcttgacagtgagcttagagttgatgtctaatgtttatttcatatcctgtttttaccttccctaatattgcatgtgtaaatctatatttaaatatattcacagctgatgttcttgtcggtccacttgttatctctggacagaatgctgtaatgattcaatttaattattttaataaaaataacttgcacccctccagttttaatttcaataaatctgacgagtaatgattaattttaaggagtcttattgatgagcaattgcaacactataatgcaggaaaatgcccaagtggtgggagcatgcttacatctatagtaaacttaaaaccttcaaaatttggtgtgtgattatgaacaccgaggaaatatatccacatttatttaccaaattattattcctgtatcttttttaagttatttaggtccatcagttatcttcaaagtttaggtttgaaactatccatttcaagaatattagccttttaagatgattataatttaaataacatattctaaaatgttttaattgaacagtagaatgcatgtaacccaaaacattataaaatttaaaaagtcacggccatttttgaatatttagattgggaaaacacttaagatgtggttttatgttcaagaagaggtgcaattatggtatggattcattcatcattatggtattgtattgtcaacttttcagttatgttcaatttttaagatgctgggtgggaaatttaagggacatatagatctaataatctgagcctaaatctcctgctctatacaaataactctgcaaagctttggaatccctttatttgactaggtgaatggcagttttgtttgcatcagcctaaacctagcttggaaatcatgattttaaagcaaacacgttttcctcacacatttccatatttcctagaatctatggttttaagatatcaaacaattcaaattatgtagttatacatttcacacaggacaaaaactcatgctgaagtaggtaaaatatttttcaaaattattttctctacatttactggcatactttctctttcttactgtcttttaaaactgacagtcagttttttttatttttctcttttactgacagctagtaaatgtactgacagttcagaagcaagatgtaaatgtaagtcactattattttgttcacctgatacctgagcattagtagaaatgcatggctatattttaaaataaaaactagattatttccaatggttctgaagggaagatgtatagaaaaactgtcctctgtaaataaaaatgtgtttgaggcaagattgcattacatttagaaatagcatactttcctcattaggatgtgattggtatttgtactgaagaaaatgggctaattatttaagtaagatgtatatttactttctgtttcattagctgtaaatctttatagcatataaatctcctttagaaattaatgggaagtatataagtgagggaaagaaagcaggttatgaagttaataaataccatgttaaaaattagtttctacttaaatataaagttcaagattaaaaattaaaaattgttttattttaattagaaaaatcttgcttagttaatttctctggaagaaatgctatataagcagttaaatgtggagaattatattctattgataaaagtatgttgggccagactgaaccaacaacatcatagaaggactgattccttacttcctttaaaaagtgatctgtcatttgtctacattataaataacagctgagttttaaaacacaaggagatttttaaaaagtggcagcatttatttatttactgcttagacagtattcacagtattttatttcatccttaagactctttttttgttttgctcccacattattgttacacatatgggaattggtaaagtgggaaaacttagcatttatagatttttatactgaagcatgcgatgataaagtagtcactttcatccaagaaccttttcctcttttcacttacactagctcttccagaaatggcccctttagtgcctttaatggttttattctccttctgtcactatttttaatattcttattcttatactgccatcatatataactttgtgaaaatttgtcatataaggttaaaattgatttgcctttaaatacagtagtttccattttctgttaactgtttgaagaacacctattgagaggcaaggaaagacctgcgggataagttacaaaaggcaagaattcctcacagaaaaagcagcaggagcttccttgtcaagagcttcagcaagtagtgtcagcagcttagaagttgctattggactgctgagtgttatgcagataaattgtggctctagcttgtcctccgatgtcattctttgatttttctctgttaacactgcatttgcatttgggtctcactgagaacaaggaccagtgcaaatgccttatggcatgtgtagaaagctgcttttatgttaaaagtgatatgttttcttgttcactgtgttcacaacaaaaattcatcttccgagtcttggaattcccttatgtatttgtaattttccttccaagtcataatattcatatacaaagagtggaaatttttctttaaaaaaacctaccaaacaacaaaaacagtaaagttagttggttactagcagcaacaactgaaaagcagcatcaccaaaacatatgcaattcatgggtttccagcaaaagaggaaatctggaaagagaagatccttaagtattgctttaaagtgagcactgaaggacagccgttaaaacaatcccaatttttagaaaaggtattattccctgacatttacttgttttattcccttctcaatctgaagacacattttggacagatgctcttgtcttacatgaacattcaattcatttgagaaaataatggttatacttaaactcgtgaagtgaaatgtatggaagtctgttgctttataactttaaatagccatgtaacttgttcatggcagaatatagtcaagtcctgggcaaggactttttttctcttctccaataatgctattcaaggggaagctagttattgtgtgacacatgcttgattctcaggaggtttggacaaaagagagggttagaaggtcaggagagcctgacgctattcaactagatatttgagtagaattcccacaccagaattttgcctcatacctaattcagacagtgtaataatgggggaagggcagagagagggagggcagatggaggtgtcctttcaggttaaatgttaaaataagggtcttcatttctgtctctggtggcacagagcattaaaaaccctgtgacacattttggaagtgttgctataaaatagattttaacgtttgaggatctataaagggtattattgagtacttaatagattctgtgtttgcctactgaaatcactacaccgccgatatatacctcattaatttgtaaagcagtttggcccaacttgagacaatgtactgtattaaagcaaagtctatatcccaaattttcatggctaataattacaaaacgttcagcatctgaagaaaattatctaaatgtgacaatattggtcttggatagtttaacttgcgtgaaatatttcacacagaaacatttgatctatattgaagagttgtttcttttttcatcagatcagctatatcacagtaaattgtggaaatagaaaatggaaactaaattgttgaaaatgcatctgatagtttgtttttattgccaaaatgtcattgtccttgaggtccatcactttgtagcttagtaaaaacagatttaggcattgcaagtgagaagtcattgactgttttccttgtaaccaatttatttatcaagttggtaagtttcagaagtatttccagtgttcagcctatttcttcacttttctattttccaaattatatcctattacttcaaagatgtataaagttcacacattctggattctttatctcttttattgttttctgcttcatacaaagtaattaaattatgttcttgaagtaattcctcctatcttacttaaaatcaccttcatgatctgtcaagagttttcaagttgttctgtgataaagttcttagagtttgagaagctaaatggtggagttggtgcttaagctcttcactgaaagctgcaagagtataaacgaagtcagaaattactattattattatttttttctcattgagacggagtctcactctgtcgcccaggctggattgcagtggcgtgatctcagctcacggcaagctccgcctcccgggttcgctccattatcctgcctcagcctcccgagtggctgggactacaggtgcccgtcaccacgccaggctaattttttgtatttttagtagagacggggtttcactgtgttagccaggatggtctcgatctcctgaccttgtgatctgcctacctcagcctcccaaagtcccaaagtgctgagattacaggcatgagacaccacacccagcatatatatatatatatatatatatagttttttggtttttgttttttgtttgtttgtttgtttgtttgtttgtttgtttttttgagacgagtctcgctctgtcgcccaggctggagtgcagtggcaggatctcggctcactgcaagctctgcctcccgggttcatgcctcagcctcccgagtagcttggactacaggcgcccgccaccacgaccagcaaattttttgtatttttagtagagatggggtttcaccgtgttagccaggatggtctcaatctcctgaccttgtgatccgcctgccttagcctcccaaagtgctgggattacaggcatgagccactgcacccggcctgaaatgactattctttttaataacttctatttattgttttgtgttattcataattgttgtgcaatttaatttatttcactagtagaacactatgtacaggactgtactgtgtggaggttttagaagtgacaaaaccagttaactaggctcttggtccaaaggaatttagtgaaagagataagacataaacactaatgactgtaacatttatggaataataaataggagctgctgaaagttgtgatttcttctcattatgatagtgcttcttggattataaaaaatttaacctagaacatgaggtttcaagaggcagagatggggagagaagaattccaggtttgggactaggatgtagaaaggcagaaaggtgaaaatattcttgtgatgatggcaaacagtgactggtcaagtttgccaagagtaggttttatgcaagagcgtagtaagatgaaaccctgaaggaattttactgtcagatgatagaaaccggaataaagctgaggatacagttcaataatcaaagggaaccaaatgaaagttttgagcaaagaagggatcttattaaaacagccttttattatttcttttaagctagaggtagcttggcattatctgtgccagctcagagtgaccttcaccccaaaattctagttggattatggagcagttaatcttacaggctctaataattctgtcaccctttgttgtcattctatatctgtgtcccttcagttatgtgtcttctcccatattctcataccattatttctctgtctttcatttctttactttcatcatccacatcaggacaatgtttttattctatagtagtttgtaaacatgtcacattctttagactttcaagctctttgtcaacagtttttcaaagtccttgccttacataaacactaattctttccctttagggacccctttcctggcccttccaagcaaagggtgctcattcatccactcctcatgcacctcattgctgggagcaagtagagatgtagggattgctttcttctttttcttttacctcatattggaaagagatgtttcctttaaagctcatgttaagttgttgtgtacctttcttcaatttttgcatcaatttttgcaaaccttgcatcaatttttgcagctgctgacaccttggataccccagccacctgcctgccagatacaatgaaaaatttcacctctgactcacagtgtttctctgcatcattatcagcttttggttaatgaccatgaagcttcactttttcacctcttgaaaacttttggctacagaatgaagttaagcgcctaggtgcttatattgtctttgagtctgttgggttccttctaggttcagtttcttcacttctagcctagcccacaaggaaaatatctttagtagtcttttaaccattttcttttatttcattttttttcattctgttgccaccagacacctattctcaaatcattcacctgactgccttcttaattcctgtgtatagattgcagaatattactgaaaaaaaacaggtgtgtggattgaggccactaaaaattaatgatttccaactagagatggacccttagtgcagccttagggtaaatttcagaggtgcagctgattcaaagggtgtgcacaatttcaggggtatattgacctactgtcttcagaaaatgtttgactagtgcagactcctaccgaaagagaatcagagtgcctattcctcaaattattgttaatataaggaattatcttttctcatttttttctaattttatgggcaaaatagtatgagtgtattcttatttcatttagcatttcttcccctacctcgtacttatcttaccttacataggcttattagccagccacatgtattttttgcttctgggtaatagctgtgtattgttctcttatttttttaaataaaggggtctgcatttttattaatgactaagaaatcttgatatatttagaaattatatgtaaaaataattttaaattttttttattctactttaagttctggggtacacatgcagaacttgcaggtttatgtcatagttataaaaaaagaaagaaagcataggcagagaaggaaaatcactctggacagaaaaaaataattggttaaaatattaaagaataaaatttgtaggtaaaaataataaattttaaaatgacagtttaaaaatttatatgtaggctgggtgtggtgccccatgccgatagtcccagcactttgggaggcctacgcaggaggatcacttgagtccaggatttcaaggccaggttgggcaacatagcaagacgtcatctctacaaaaaaaaaaaaaaagaaagaaagaaagaaagaaaaaaaattagccaggcatggtggtgcatgcctgtagtcccagctactcagaaggctaagatgggaagatcttctgagcctgggaggtcaaggctgtgagccatggtcgtgccactgcactccagcctaggcaacagagccagatcctctcgcaaaacaaacaaacaaacaaattacatgtgaaaagaattatacgtgaagataataatttcagacatacaatcctatgttaactcccatagaaaattaagggagttatcacacctttgcttttaacaattctttctcttcccacattccagttttgttgaaataagcagagcttcttatcccagcttattgtagcaaaatcattatagtaaaatgatatttttatttcaagcattacaatagcactttataacttatttaaaaatttatatgatgttaaaaggattcaatactcattgagtatcctttcataacatacatctctaatttcttaatttgaattgagctttctatttggtgagagtatttctattctgaaaaggaacatggccagtgatgtaccttctgaatctttgcgtagttgagcctgtctttctaatgcctgtacccatgaacaatgtctggatgatgatggatttttttttcttataccctttcgtttgtgagcttttaatacattgcatcgtgtttctgaagagaaatctgagacaagcttaaggattatttttcactgtgggtgacccgtttttgtgtgcctgagtgagattcttacaggtttctttctttatccttaaaatcccaggactaccagcctatagtttggtgttaattaatctttgttttcttgagaatatggtaagcttttcttagctgaatattcaggtcatatttttaatcccttaattttggtttctatcatgtctttgagtttatattttcattatttgttttcttcgggctttcatcctgtgaaatttagtgaccaatatagttttattccttttatgtccaagatacataagaagttgtatgtactctagtgtccattcgttcatcaacttattccaattaccccaaacccctatttccaagggcttttcttcttccgttcagactctttatttgggtcttttcgtggttccttgcttaacactatgcacttttcacggcacacactttccctgggaattcttactcacaaccatgactcctagtactattttcatatgcatagttataaaacctgtaatttctaaatttatattgccacagtgctatcagtgagctttcaaaattcaaattcaagtatgatttttcttagttttaagatttcttcagttggaatggagacccttaatgacttagctctgacaactgttcagcctcatgttctgtaaggtctcctctgggacctcacattctagtaacactgagctgtctagtctttaattgtatccatctttcttatgttgctacaactgcacatgttctttaccaagaatactctcccttactatttattccgcttaatcctactttttcctttcactcatttggcatcaacattttcaggaagccttttcttatctcaaaatctgagtagacatgcactcatcctttctatgaaattatcgcaatttactcaatgtgctttatttgtgtccatcactagactccagaacttttagatcaagaattttaccttatttagtgttgttcccttcagggctcggcatcatgtttgaatgtgatccattctcaataaacaaagtttgattgaatgagtgatggcatcatccagtattagaacaaagttgataggacagtttgtttagaagctcttgcaagaatacagttgacccatgaactacaaggaattgaattgcccaggtctgcttttatgtgaattttttcgagctaaacacagattgaaaatacagtacttgcaggatgtaaaatccgactatgcacagggccgactttttgtatccctgggctccgcaaggctaactgcgagacttgggtatgattagattttggttatttatgcctggatcctggaaccaatcccttgaagactgtacagatgagagatattagttgatcgaatatgtagcaggagaaaactgaaaaaggaaaagaaatttatgaagtaaattaatgagaccgctgcatttcattactactttggagattagaggaacaataaaggtgactttaaaattttgaaccaacttctttataacatggcttacaagtggtagctagaaagaggagggttggttacttttgctttgtatattgcaatacatttctgattgttccctttccacttttccccctagtattgttgattactttgtctttgtaaaaaacttcatcgtgaaaatttctttctaaaatgtaaatgtgattacctccttcctctccttaaataaacactatgctcacgattgctcacactccagagaatgaaatttccttcccttagcaacatgttcaagatccttcaaaatttgttagatggtgcctctatagcttcattgtccttctatgtactttgagttttaaccatgatatttttttgcctcccaaaatcatgtactttgtggttttcatgcaagctcttcctgtttgccttattcagttgcttctagcttgtacacttttccctctccctcttcaactccatttctttgtgtacgtatctcaatgaccaccacaaatacaacttcctctgtaaaacacactaatttcttctctccttttctcctctctgctcctatagcacttttttttcttattggctgtatgacatttattacataggcatattttattagatattaagtaggttttgcattaggtatatttttgaatgtactgaaaggcagatactttattcattcatatgtgctcagaagagcaaaatatctcttacataatgtatgtttaatataagtaaatatacaaacaaatagaaatattgagtttggtaaaagatgatattgagaaaaagtgatatgtgatagaatgaaaagctacatatattttctaaatgatgggtggacatttacaactttgctaaattatatattaaatcatctctttatcctgaaaaaattatcttttccatgattagtaagtactttacagtctcttctaggttataaagctcagtactctaattagttttagaaaaactgtgactaaactagcagtactgttttttctcccatattttgtctcacactgaagtcagtgatatttttttctgttcacagatatattcactcttagccttccctgagctctattacagcctggaaaataactggaatttcctttaaaataatacacattttcttaacttatcatattaaatgaaaaacacacaaacactggcctcctttcacattccctagaactttttgttttttctgtatttggcatttctgatgtctttaattttttgtgattctggctctgtattctggtgcctggaacagtgttgcttccaaataaataggcagtagtgatagcaatactcataaatattttaagctatttggaaaaagatattttttagaagctgtgttttgaatgaccttcccatttaactacagtgaatttcattcttagttccttcccaatatctaccctcttgcatcttcttttatgttgtttctaacgtcttttgcggtacctatcaatttactgtcatctactgttttcattaagattgctacttgtagatcattaataaaaaggtgaaataaaactaaattccttatcaattctctccttaagtcaataagtatccagttttaaatgacagtgcttgaattcaagttcatattaaatgttacttcaaataagtttgggagtttacacatacatggctctttggttcaattacatttgtcttatttattttgttttctgttcccttgtagtattctttgataaacttgtcctttaaaatatatattccaactaaactctgcttagggcctaagtggtgtagccctctggggagggtcgcaaatgtaatttgtttgattggatactcaagcttttcaattgttttcttttccttagagaaatagaacctttctagctttcaggtcaattgatgtaatggttggattcagatggaatgacactttctccccattgtaagtctctagttcctcagagaaatccttgggaaatctgttgacaacttgctgtcatccagctgttctgatggtataaatgacttagacactgattcctggtagtttaaaagtctaatggaacagtgaaattttgagatctcaagtgcatcatgaataaagcacttaagtagcacttgtatatacttcttacaatttgttaactggttttctgctttttttttttgctggagaaagagatttacagttttaatctgattagacattagcagctggttgaagatgctattactgtgaagtatggaaaagaacacaatcatgatgaaaactttttactcaaatccttagaagaagaaagcagatgaaattagattggcaaaggaaaccagcccaaattacacacaggagagaaatgtagcagaggagagtactgagttggtgctgcacgcatagagcttacagcctccatgggcaggggacatgtgggtgtgactgccagggacaggaattgcaaacagcatttggagtgacagtctgggtcagcttctcatgctctttcccatcaccaggcatcagcgagtggaaagatttgacctgattttggagcacagagtgtgggctctaaggccacaggaaggcaggtgaatgggactaggatgtagtggagtccccatggctaaaaaataagttgtattgcatacctgcctttgccccacaattatcaaatccaatctagggtgaatagaaacacatctgcagacagatccaatgtccacctacaaaaagtttcagaaaatgaaaacagatggagaaaaaaaattataaaaatataaagaattctggtaaagttgccaaaagaaatgagtcttctagtcaaatgggctttgttctattagtagatgttgagacgaatgcagtgaattgattagagctgatgttatttgtttgggtgcatacatgtgtgcctggtgaggggtgggtgagggaagaaaaaaaactcaaacaaataagaaacatattgagagaaaaataatacctagagaattaaaatagtacactataacaaagtttgtgagtgattattaaggcttgtgtgggtattcgggggctctctgaggtgtcaatatgtaaactgagatctgacagtaaagactcagctaccttatatctcttcatccctacatcttgttctaagaaaacatcagaagtcctgtgatctcagcataagttgaaaactcgtaagtagtcattcaaaggtggatttgtggagggtagaggtaaactaccttgattatatttacatagaatggaagtgatgctaatttagaaatgtccattgctgtaagtcttaggagatgtaaagtaccaatgaaagatcctgaacagtattatgtgacagaaaatgagcgttacacttttaaaaaaatattagatgttgtaactttagtcattctcacctttaccttttaagtatttcaccatttaatatcaaccttcattattgatttatttctaaagatatctggaaatagtttaggctcattaattttctttttaagagtcaaatcggcatgcaaatgtttctcccaccaagaaatttttttcctggacttcaccttctgaggcatgtccacctttgaggcaagctaagccaggctttgtgaaggcagaaccatccgaagcacacagccccaccaaatttctctccctccttccctccctcccctgttcctctctccttctctttcttttttctctttctttctctttctttctctttctttcttccttccttcctttctttctttccttctttctttctttctttctttctttctttctttctttctttctttctttctttctttctttttatttctttccttctctttctttctttttatttctttccttctctttctttctttcttttttttttctttctctttcttctctcttcccccctcccctgctctcccctgctctcccctccccttccctttctttcagctgctgcttacctggggtaacatggtttgggaagaaacatgtcagaattggagtgaataaatataaatgataaaaagacaaaatgaatattattttcaagagtaattaccagtatgaagttcttcagatgataacaaaaactattgacttattttgtctaaatcaatgccactatcttatctgtgtgattgtgaagggaggaaaggaaactgttcactgaatattctgcatttgacccgtaaatacctacttttgtattcagggatgatatattcttaccttaaattaatgactgttttctactgttcttttttggtgcaaacaaattaaatgtgtgcacttctccatgactgattgtgcaaaaactgcttagacaattactatctctctagcttttgatcagaaaggactaccttgaaacaatggccacaataatggtattattctcaattctagaatttatttaaacaaacaattcaaatcatatttcataatacagttctctgaaggagcttaaagagattcagatttttccttttgtttaacatggctcttcatttagtttttgaggcatatttttaataaattttgctcagtactgtctactggagctgaaaaaatctaagaagacacaaaatggctgaagcataggtacttacagaaaagcatgcctttcttttaagaatataaaattaatacattatttatttattatataatgggatgttctacccttgttgaagattttagcagatataactcatgcacagtgtaagtgagcattcacccctgttttgtttatatggcaggactatttctacaaattttacaaattactgtttaggatctttatgacatccattgagtgctggcatgataaatgattttctatatatctgtctacatattgagggcctgattgatggcccttctgacttggggtcagcagtgagttcacatctcttggtatactttggcttattccctggaagtataaacagaaatccaatgaccactattttcattattttccttcaggcataatctgacctaatgatatgtaactgtattactgtgatttaagagatttttaaaaaactataaacattttgaggaaaagtgaaaatggtgattttaaatttaacacatttaaatattcattttatgaaaagaatatttgaaagaatagggatttatcaggatcaatagaaggcttggagtaacctaatcattttaaattttattccttcttgtttttttctgttttcccacaacttattcactaccctctatattctcatactttgctaaatcatattaatccttcaagagttggtttagatgaagcttcattcatttgataaagattaaatgagtgtccagtagttgctagctcaccttgttctgttgtgcttcacagacaatgtgttttatttttatttttattttatttttttacaaagtgaaggtttatggcaaccttgcttcaggcaaacatgtcatatattagtgctatttttccaacagcatgtgctcgttttgtgtatgcttcacattttggcaattctcacagaaatttaaatttttttccaatcattatagctgttatggtggtctgtgatcagtgatttttgatgttattataatttcagggggtgccatgaaccacaccaatatgatatggcaaagttaaccaataaatgttgtgtgtgttatgacttctccaccgacagaatgttcttctgacttgttccttctccttgggcctccctgttccctgagacacaacaatattgaaattaaattagaccgagtaataaccctacagtggcctctcagtgttcaagtgaaaggaagagtaacatttctctcacttgaaatcaaaagctagaaatgagtaagcttagtgaggaaggcatgtagaaagttgacaggttgaaagctagtcctcttgcaccaaacagccaagttgaatgcaaaggaaaatttcttgagggaaaattaaagtgctactctaatgaccacaaaaatgataaaaactgaaacagctttattgctgatgtggagaaaatttgagtggtctggatagaagatcagaccagctacaatattctcttaaaccaaagtctaatccagacaaggccctaactattccattatgtgaaggctgagagaagtgagcaagctacaaaagaaaagttggaagctagcagagattggttcacaaggtttaaggaaagaagtagtttccataacataaaagtgcaaggttgaaagagcaagtgctgttgtagaagttgcaagttatccagaagatctagataagatcactgatgaaggtggctacactaaacaacataatttcaatgtggatgaaaaagtcttctgttggaagaagatgccacctaggactttcatagctagagaagagaaatcaatgcctagtttcaaagctccaaaaataagactgagtctcttgttaggggctaatgcagttggggactttactgcacaggtggtaggtgccctaacccccatattgttaaagggtcaatggtttatagaaataatatagaagtaagtgtgtgattctatctaatctatctatctagtagtatctgtctatattcatattccctatatatccatagtccctacagccatccactgaggggagagagtgggcctgggagtagtaacactgaaatagcacgaatctacttagcaccgaatctttgttcctaaagaccactcatctcttagaggaaccaggattccttggagaaatggctgattccagggctgtggtggggaagtacaaaatgagcctagaacatcttgtgtcataaagtaagaagatacttaaagaattattagaacatgtcaatatgatccagaatgcagctgtatggggtctatactgtccaaacctggaacaacttgagcactgaaatacatattgagagtaattaattatatcccactgagtaaaatagagactcatgagtctatatagataaaaataagcctaagcatatattgaatttttaataagcaataggatatttatacagtcttgaagtatctgctcgcaaaatgtttgctaattgcaaaggggaaaattgtatttttacagtgtggaagcctggcagatatattaatgcaaatgattaaagttaacatcattaataatggaacaaatagaaatgatgtaagacatgataagatataatatgatcactgtatcacctgaatttaatcatgaggaaaaattagacaaacccaaattgagaggcaatctacaaaataactgggcggtcctctttaacagtattaagatcagaaaagccaaggaaagattgaagaactctttttttttttgggtcggcactgcttttttattttattttattattattatactttaagttttagggtacatgtgcacaatgtgcaggcttgttacatatgtatacacgtgccatgttggtgtgctgcacccatcaactcatgatttagcattaggtatatctctcaatgctatccctcccccctccccccaccccacaaaagtccccagtgtgtgatgttccccttcctgtgtccatgcgttctcattgttcaattcccacctatgagtgagaacatgcagtgtttggttttttgtccttgcgatagtttgctgagaatgatggtttccagtttcatccacgttcctacaaaggacatgaactcatcagtttttatggctgcatagtattccatggtgtatatgtgccacattttcttaatccagtctatcggtgttggacatttgggttggttctaaatctttgctattgtgaatagggccgcaataaacatacgtgtctctttcagatcaaaagaaaacttagagtcatgacaactaaaggcaacatgtgatttggggctggaggtgttttttctataaaagactttttggggtcattgacaaaacttgaatgggctttaaagataaaatggtaatgatatacgaataactttgatgtttacatcgtgcttatgtaaaagaatgtctttttgtagcaaatacacgttgcggtattcagggggaatgggtcattaggtcaaaaatttaatctcaaatgggtcagaaaaaattctttgtactactcttgtgactttcctgtaacgttgagatagttattttttaaagtaataaaaaacagaaactactgattgagctgcattacagatagaatgggaaaagagaaaatggacagaggaagtacaaacaacttacttgaggaacacctcaatagagagaagaagagtaacagggaaatatttggtggaggagacttccaagatattttcacgttctcatctttgttcctaaccactttattcatatttatttattatattgcctcctttcattgaaagtattttatacgccatttctattacagattgtaaattccttgaagaaaaggtctgtgctttatataccccttatgtgtagtatatgtagcatcacacttagcatatcataatgtgcttgtttcatattcaaacaacaggaccattttcaaacaagtgattggattttagtgagagtatgaagagcagttttctttataaacatgggagacaaaagaggttgactcacttttaaggagaggacattgtagttataacaagtaacttctagctcattgggatgtaacatgctgaaaaagttttctaaggtattttacagctaacttgataatcttttggaaatcatctgttctccatgagtaaaatagaaaaaggcacaatgatatattgaaataattaagagtatctaatattgtgatgaagtgtgcaccaaaagctttcttaaatgtagaagtgtacatgacacctctttaagcagtatctacaaaaaaccagctggaactctccctattccttaggaattcaataaatcagactgttggcagattttccatcatgtatatgtgtaaattaatagcttttttttggcagtagagagaagagagtaatctaaatgtgtaggaagaagaggccatgagagtttcacatccagtcaagataggacaaaaaaaaatctacttgcattcctatgttaaatttttaaagatcaattaaatggagacttgtttggtggaggttgcagtatatgaagagctttaatagagatgaggggagaacagcaaatccagagaatcatacccagggcacaaatgtaatacacgtaggctttttctgtagattgcttcaagagcctggcttggcttgtctgagttactcagagaggaaaaaatgaaagtgagtgtatatgttggtttggggtgtgtgaaggtgtgggaatggagagaagtggacagagggaaaatgtgttgaaataaaacaccaggagctcatggaaaatgcaaaacagaaacaaaaccaagaaaaaatctttgaggggcatacctgtgtatgaattcatttttccatagcacctttaacatagtcaaaacaaataaaatttaagcagttattcagtcaaactagtagcaggtgcacacacacattccaaacattacaaatatttgtgggccacccacctggttaatttctgccaaagcaactatccctgaataatttcctcaagtacttattcatattgtttgtataaacgtcactcaatagagaatatttaataaactggagcatttataattatataaaaattcatgtcagtaaacaaggccactctgaaaagttatgtgaagaatcacagtatgacacattttgttagaaaacggtgccttttctttattgcttagagttgtaacatcacatagttcatgttgttgttttcattttcggggtatcaattagttgatcaatcagttagtgtttattaagcttctgtccagcaggtaaagcatgctcatcaaatttgcaaatgacataaatgttagagggatggtaaaggcactgcatgacagacatagcatccaaaaagattttgacagctcggagcaataggctgaatctaacaagatgaaatataacatagataaatataaatgcctacctttgggtccacaaagccaactgtacatgtatagcattgagtagatgtgaattagctgttgatgtaagcaggaaaaaaaagacagtattttagttaatagtcagctcaacttaatttatcagttttagctgcatgatgtcattgccaaaaatctagcctgcaattttgaattgtattaaggtgacaatcctgtaccagtttgacaggtcagaccacatctagagattgtagtatttctggagccacattttaagaagagagacactaaaaactatgtcatatttagaacatcacagaaactaaacacatttatcctgaagaagacttaggagaggaatgacatccttctttacatttatgtaagctctcacatggaaaagggattaaatttgtttggtgcagtctcaataattagaactggaacttgtgaactgaagttataaggagatacctttgggttcaatcatttataataattacatataatagtaaaagctgttcagagagaaaggcgttcccaaaatctgcagaggcagaatactagcacagtttagcctgagtgtcctcctttgcaaagtggggacaacaccattgtgaagcagcgatctgggaaggcagtgggatgatatagggaaaatgttcagcacaatgaggggcatgtagtaagtaagtggttatagtacacaggggatgtcacctttcctattgtgggaggtggtgacaccaatcctgaatcatcactgggtagaggtatagaagagatgctaaatggatggatttgacaaactgactgttacttcaaaaccctaactgactgcaacttattaattaaatttgccatttaaaactgtctctgaaaccaccagtcacgcttctatagcaccttgagtatttttttttttttttttttttttttgagacagagtctggctctgttccccaagctggagtgcagtggcgcgatctcggctcaccacaacctccgcctcccgggtttagcaactctctgcttcagcctcccgagtagcccggattacaggctcgtgccaccatacccagctaatttttgtatttttagcagggacagggtttcaccatcttggccaggctggttttgaactctttacctctttacctacctcgtgatccacttacctctgcctcccaaactgctaggaatacaggcgtgagccaccgcaccaagctattctttttttcttttttttctttttttggatagagtctcactctgtcgcccaggctggagtgcagtggcgtgatgtcggctcaccgcaacctccacctccccggttcaagtaattatcctgcctcagcctcccaagtagctgtaattacaggaatgcaccaccacaactggctaatttttttgtatttttagtagagacggagtttcgccatgttggccaggctggtctagaacttttcacctcaagtgatccgcccacctcggcctcccaaagtgctgggattacaggcacgcgccattgtgcctggccaaatttttgttttcaatcctctgtgcttatttttaattatctttaaaatggagaaaaaggtaaacctgccttaggtaactgtaaagttaaaaagaatgaatatgcataaatattttagaacaatgtctgacatactttttttttttttttttttttggcagagtctcactctgtcacccaggctgtagtgcaatggcgccatcttggctcactgcaacctctgcctcccgggttcaaaagattctcccgcctcagcctcccgagtagctgggactacaggtgtgtgccaccacacccagctaatttttgtatatatatatattttttaagtacagacggggtttcactatgttggccaggctggtctcaaactcctgacctcatgatctgcctgcctcagcctcccaaagttctaggattagaggtgtgagcctccatgcccggcccatactagctttttaatatatgttaactacttttgtaatgccaaagtaggtggcaaaggattattggagaagagaggacttgagatgtgtgttttgaaaaatactaaaaatttagttaagtgcctatatggaaatagcttgaacacatcatgagattaagtggtgtgtgatcgtcagacagtgaggagactttaccagttagattggaggtcggctgttggtgaaggttagaaataaattgggtgagatgagtgaggaaaaatctcagaaggccttaggtttaggatggtaagcaataggatgggatgtgtggggattccacgtgttcgtaggtaggggaatacaacatacatgtgatttttaaaataaacttatagagttttcaggatacattgccttactttagcttaaaaattatggatggaatagtggaatctttttatgcaaatccttctttcacttagaaatagaaatttctatttcagggcaatttctatttcagaaagtccaagacttttctcctccataaagttttctcttctgattcatattacagtggttttctttttgtttgaatttcttagcattcaaaatgatgttccttatatttgtatcatccatcatgatcttttaaggggaaatttaaatttaagatacgttgtcaaatcgcttaatgttaatctattagaaaggtgttattctgaatgcataaaatggttttgctttaaatgaggccctccaaattaataaaactgctcttcctgggaagcttctaagttggttctgggaaagcaagtcacacagagaaggtccaaaaatacgttatacaccacatatattaacaaattaagacataatttctcaaagcaactccttggaaaagataatccttcttgactgcattaagattcagtatttaagttagaaacaaccatcatcatttatagtgattcaaacactatctagcatattaaaatgtattttgttgtcatcatacatacaagctccttgagagaaaggatcatgacttaactcttgttggtgtagctcatagggccactgtgggtaccgagttgatgctttatgaattcagtttaaattagaagaatgtaggcaatgggattaccatttgtccagtaacaaattcagcacaggtattctgtctctctatttcccagcctgagtcagcagtttcttttagttctgatggccagcaggagtaaaatagcagcaaagatctggcatttcagtggcacaggtgattgtggaaaattactataatctaggtggactcgattctattttccccttgctaggtactgagatattgtgtaactttctggacttttgaattatacttctcactaatctagcatgagaatgggtggatagtgtcaagaattctacttaaaaaaaaaaaaatctagtgtactcttgtactcaaagggatgagtacaatctatcacagggacacaaatgtgaccaaaaaagtggttaaaataaaatatgaaactgaagagaatgaagatttgagcatgaccttctctgtatcttctttccaaagtgttttcggatctcttatgaaggggatttaaaggcttttctacaactgctactgcttttgtcaattcattcattcaagacacaccaataaacatgcacgagctcctcttgtcctcatagggctagagaatgagataggtgcaaagtttattttagcagaaggctttcttttcacaaatcagaaattccattgtatgtattcccttaaataactggcaaggggaccatcggaatgagctatggcaaaaatccacctcagtctttacagcttcagggtgatggggccccagatcagaattgtaaaatagtttagagaatcttggaacataaaacatggtgcagaaaaaccaaggaagatttaatcttatgtatggaaaggtggttggtagtggagggggcaatggaagagagtggcttgggatcatcattaatcattatttaagtacctataaagtgaaaatatccttctggaattcactgcaagtgacactgaattcttctactaagcaaatatgtgatgagttgataaaaaagaaggtcctgaactcttgacaacagatataatacagtgaatacagaaaatcaaaaacatgctttctatctgactcaaaataaaggtgcacttaaacttgtaaaagacaacatttttatttgaatgatatgacagaagtgtcacgggagtgttacctgctataaagaaagcctaagaattattacctttattagaccagtgacactgagctttagccatacatttctaacttctgtccctctacagagacaattttcttttcttaaataaactgtcatgctagtgttaatatattgttggctctctcatgctctgagaatactgctgatataaaacatgtatatgttagattggtaatagtatctttagtgtagctgactagaacaaatgtgtttccctcatggctgtgctaatgtgataaaggaaaattggctgttcatcagcttttggctgggtaaagacagtagagatggaaccacattcttttttatgcattaataccactgagaacttttcactagttatatttcatgtgcctgcatgttgtgcaaagatgttgtaaaacatgagataatgctacaaataacaaagtagaaaagcctgtatcttttataatgataacagtcaaacaccaaatgacagtaacaggctgtaaaaaatgggatgcaaaaaaaatgcagccctactacccaacaaagcggaatatatccaggcccttgaggacttggtatatgatttgaggtatattaaagctttgttttaaaattaaatcaaatgcaacactagatcaatggatttaagaaagaacatagtttaaatgaaagtagggtggttagaatggagaaaagccattgtgggtaacttcttgaaataatccgtattaccaagtaattattgtagtaacttcctgttttttttgttttgttgtgttttgcttgtttttttggggggggacattgaaaaagatttttaaggcaatagtacacatgattttaagatgtttgagaataaatgtttatcttcattaattattgcaagtctttttaacataaaagcattaaaagtataaccagtttcaggctcacagcaaaactgagtggaaatttcagagatctcccaaacatgctgtacccccatgtacccacagcctccccctctattaaagccctgcaccagagtggtatatttgttacaattgccggacctacactgatacatcattaccactcaaagtccatagcagaatagcatgttgaatgttttgctatcattttaattaaaatgttaacatccaacctttcctttgcatgaccttaaatctcactctttcctcccctctctcaacccctcccctttccagagccttttatttgccatttcagctccttcactaattagagtaccaattattcctttttcatttaagctaaaagcacttgaacaaaaagactatttgcagagatgaagttgatgtccaaacagctgattagtttatttagaagtgtatgcaattaaaaattttgtgcaggtatctatgggtgttttccataaaagtttgatagcattggctattctgggctccagtcgcataaacaaaaatcccatagctttttaatcatgtaatccaagagttatcaagctacaacctgtgggtcaaattggctggccacctgtttttataaataaagttttatttggacacagccatgcccatttgtttatatattgtctgtggatgcttttgcattacagcattagagttgggcagttgtgacagtaaccatttggcccataaaaccaaaccatttgacttgcagagaaaaaaacattctctagctatttacagaaaaaaaaaattgctaatccctaatatgtgcagttattaggctacttgcttgattgattagtctagaatatgattggcaactttttgttaccctacattggaaaagtatatctgaaaatcaccaaccggataccaatacccaagacagtaaattcaagaaatatttgatcctagtaacttgaattatatccacatgcaattctttgttgttatatctggttttaattatttctttcccttgtactcattttgctctatttccaaatatagccataacaaatttaatttgtatttaaagaagtaacatatcctcaaaaaccctgtaaaacatggcaaccagagctgttacatgtatgggacaaactattatgtatacctgtgaacaccctgggagatatcatcacagcacaaaatgacactatataggtttatatctagataaacacatggagatatcactgagctattaaaataatgttttcagtcttcccagctgaacaaagtaaagaagaaagaaagttacttaataaaaactgctgaaatgtgtttaatataaaataaaagtttatgcacttaaactaataatggtggtaatttcttacaggtgcatcagacaaaaatcagcttctttatcaatggcgtggagaaggatcatacacctttcaatgcaagaactctaagtggttcaattacagattttgcatctggtactgtgcaaataggacagagtttaaatggtaagtttctgacttcagaatgttatttatttcatccaattacattgttcttaaaaatgcatcaaacaaataatattttaaaatatctacgtgtattcatcttctagggctactgaacaaattaccaccaactggatggcagattaatgaaagtaaaatttattttttcacagttttggaagctggaagtcagaaattaagggttcagtggtgttggttccttctggaggctctgagggcaaatctattccatgtctctcttcgtggtagctactggcaatccttagtgttcctttacttgctgcttcctaactgcaatcttgcctcagtcttcatgtggccttctcctctgaatcttctcccctttacctctgttataaggacacttgtcattggatttagggcccactcacagtcaggaggatctcaccctgagttccttaacttaattatacttgcaaagaccctttttccaaattaaagtcatagttacaggttccagatggataatagatcttttgggatctactatataacttactacatttgggaagctttcaaatataaacttctttattctgatcagtttttaagtaatttcaatgtgtaataaactatatttcctttctgtctcttttctgaggggtttgcattttcatgtagagaattgttaaagtagaactacgaagtattagatggaacctgagaaatagtattgacatgtaattaactggactgatgtttacatttactacattaaaaatgggccatatagtttaagaagatatcatatactatatattgaataaaaccagaagttgaaataagaaattatcttgaaatatctagtacagtggtctttaaaatgcctgcatattaaaataaaaatagtattttatattattatataatatatgctcattataaaaaaatctaaacaatatggaactctgtgaaatagaaagtattttccatatttctatcttcagagatagatataatttaacttttttatactcctacagatttttagtacatttttagctagagatatagttataaatacatttttccaaaaataaaattacaatacatatgcttcctctgagccttctaaaaataaatacttctccttcaaatgttataaacaacgtttcatgtcaatgtatcttctcatttagatatatgttctcatttaaaatggctgtattctatgcaattgtatagttgcaatccatgagatttcttaagctcctataatgaacatttaggtttttttaatgtttcagtgcaattagcagttattttatggaaaatattatatatatatccacatatatttatatatctgtgtctatatctacatttccatttatatatatcaaccatcaatctatcaatcatatacatagatgtatacatacgtacatatgtatttgagcagttgcctgattgcacagttccttaatatcctatttggtgccaacctgcgtgaattcatatcccatttcctcacttactagctatatggcctggcaagatattttaatatctctaaagtgtagtcaccccaactttaaaatgatgatgatgatgatcataatattgatttcccatagggccaatgtaaggatcaaatgaagcaatgtcatgtaaaacattactgtgtttcaagcacctggcatgtattagatattcaatatttatttgttaaatgaatgaatggatgaagtgctaagcacaatgcctgtatataaactatattttctctttcttgggcatggggctggattttaatgtacagcattgttaaagtaggactgtacagtattagatgaaaactgagaaataatattaacatataattaactggactatgtggtttatattttcgcacactaaaaattggccatgtagtttaagaagataacatatatgctatatattgaaaaaaattactaaactatatcagtaaataataataatattattattttattattatttttttttgacagggagtttcgctcttgtcgcccaggctggagtgcagtggtgcaatctcggctctctgcaacctctgtctcctgggttcaagtgattctcctgcctcagcctcctgagtagctgggattacagatgtgcaccaccacgcctaacttttgtatttttagtagagatggggtttcaccatgttggccaggctggtctcgaactcctggcctcaggtgatccacccaccttggcctctcaaagtgctgggattacaggcgtgagccaccgcaccctgccgtaaataatactattattaatgttattataattatttccaaaaaataaattcatagaagttgaatggctgggttgaagtatatggtcattttatattttaatacatattacagagattgctctaatgcataacaatgggctacctccagaaaggttgtgaaaatttataacctcattaaaatatatagccaagtacttgtttccttaaacactaactatccttacaaattatccacttttttttcacccttgacattcctctaagtgaaaaatattgttgaatgctgactcagaattatttggccattaatgagtttgagtagctttttacgtatgtcttgatcatttgcatttcatttatgaattccttattcatacaatgtgtccatatttatactctataattccttatttatttataaaaactcatttatgttaagaatattatgttgtataagttttcttcagttttttgatggcttatgaactttgtggtctagatattttaaagtaatcctttaatatttaagcaaaataaaacatgtatgcaagatagtgcataaatataaaaggtatagcttgatgagtttttaatatttatatacacctgtgtaactctcatttaaaaaaagtcgtagaatatttccagaatctcagagtcccctaatgaacatccactgtaaagataaaaacagaatagcatcaatgtagccctctataaccatagattaatgttgcctgttctcaaactatcatacaaataaaatcatgaagtaggtactcttttgtgttctttttgcttagcactatgccaatgagatttttccatagtgtatgcagttatatctttagctttagcaaataattctgtaaagttttccaaagtgggtgtcccaacaagcaacatttgaggatttcagttgttccacatccttatcaactgttagttttgccagatgttatcattctttgccattcttgtagccatgtagtgcatttcctgatcattagtgatactgagatcttttcatgtgcttatttgccaaatgaatatgcttttttgggaagccttttgccaagttttaattggacagtttgtatttttcttaataatttataggaggtcttccatattttgaatatgagttctttgacaaatacatgatagcaaatatggtcttctgggctaaggcttacagtcacattctcttgatggtatttgtcgataagcagatcttcttaattttaatgagtctaatttagtcattgttttatacttaatactttttgtgttctgtttagactatttttgcaaaccctgatatcacgaagatatcctcctacagtttattcaggaagctttattattttacttttcaaattttggtctatgttctatctggaatagattttttgaggttatataaggtaggggtcaaaatttttgtcccacctgaatgtgtaattaacctagaaaaccttgcctcttgaaacaaatcaatgtttctaccattctgcagtggtaacgttgtcgtgaatcaggtctctgtatatgtgaagatgggtttctttctgaactttctattctgccccagtgatctgtctgtctgtctatacttgggccaaaatatttagttttaattactgtaacttcatacatgtcttcatatctagtagttctccaactttttttcttttaagattgccttggctattatatatgaattttagaaacagtttttcaattttcataaaaaattctgttgagatttaaattactcatttgtatttaggagaatgggcatctgaacaatatcaagtatccagcccataaatgtaatatattccttgatttctcccagcaatgtttttagttgtctgtatagaggtctcactcctatttgttagacttgttcaaacatattcattggttttccttcttaatagactatttttttagagcaattttagagtcacagaaaaattgagtggaaagtatagagagttccagtatactctctgctcctacacacgcacagccttccccattgtcaatatccctcaccagagcggtatatggtatatttgttacaattgatgaacctacattgacacatcattatcacccacagtccatagtttacattaaagttcactcttggtgttgtacaacgacaagtatccactactccagtatcctacagagtagcttcactccctaaaaatcttctatgttcctcatattcatccttatctctatcctaacccctagcaatcactgatcttttcactgtctctgtattttcaccttttctagaatatcatatagttgggataaaaaaatcatgtatcctcagattggcttgtttcactgagtaatatgcatgtaagatttctccatgtctttcatggcttggtggttcatatcttcttagtactaaataatattccatggttagatatagcatagttgatttattcattcacctactgaaggacatcttggttgcttccaagttttggcaattatgagtaaagttgctataaacatcagtgtgtaggtttttgtgtgaacataagttttcaacttataaataccaaagagcgcaattactggatcgtatggtaagatatgtttagttttgtaagaaactgtaaaattgtcttccaaaatgactatatcgttttacattcctatcagcaatgaaagagagtccctgttgccccacatcctcaccagcatttggtattgtcagtgttctggctttttggcctgttggttttcatgcaattatacttagtattgtttttgaacttcatttgctaattttgttactattgcattaaaatctaatcagtttttatatttacctatgtttagtgaccttgccaaactcattattatgataggtacacaatcctatcatttgcacatatcaggaactcaactctttttgaatgtttgtaataaatgtatataatggacatgccataaatatctcctgtagatatttttgtctgatgcacttattaattctgaaataatataaaatgttattttgtttttctgtatgacctgagttattagaccaatgtctagttttaaaaaagaaggtatatatttttgatattcaaaacactgtggttaaattgccaagctctggtttaaatataacccaggtgtgcttctttgatcaaaatattaactctctttaagtctggtttctaatctattaaatggtggtttaatatataattcataggaatcttataagaattatgtgagatgatgtatgtttagaatataagttgcttgttgtatagtaaatgtgcattaagtggtaactatttttaaactctttgaacatcaattttcttattgtgaaacaataagatagggataacactatatttccatatgattgttgtaccaatcaaaagagaaaatatgaagaccgtattactttagtttgtgtatgctcttagatcaagctaaactcatgtgaagaagcaatattttaaggaacttatatatttaggaacttggtttgagtaattagtataatgcataatcttataaaatactctgcgtgaagaatttttaaataacacattaaatcttgtgagccttatttcaatatttaatccccattagtacttctaaaagtgttttattgcaccaaatgttgctcaaagtatttgatagcgccataaattagtcccctatgcactgcagggttaaaatggcttgcttctattctacttcagtatactaaatgttggattaatgcttcaaaagaacagtgtgaactgaagatgatatttttaaactgtgtagaaataaatttcactcctgattagaaaacatgtaacaggaaaccggtttatttcaaatattatttagttttcattacaactttctcctttatgttcttgacatctgagagctacagaaggaaaaggatattttaaataatttttatctttattctatcaatttatatgtacagtcgtacctactgtatcttttctctaattagagatggcgtatagactggctcattacttctgcctaatgagccaggctccatgccacctctctaatcagaaaagagataggtacagaatgttcctatggacttattataaatcattttctttctcttacttgctcctttttttaatcaaaaaattaagtcactgtcctccatacttttgtccatatccaagatggtttctttcaaaagaggtaattgtgcaagcgattactgagctgaattaaaggtgctctcatgcagtgccaggccggctgtctctgctttggaacagacactgcctcaaacacaagcacatcaaatgaaggcctatagcagatcaagatggatcttttctgtctttctctgattaggtttgacttggttctctgtttctgcacccagaaagtaacaaccttccatatgagtgttggctactacagagctttttctttgagtcttatctctagcataactctctagaaaaatgtgttgccagtgacactttctgttactgcaggacttgtctttgctttccctggaaaagtaatcaatggaccaaatgcatgctttttactgaaccctcatttatccttattaatggtataatctgatttgatcaggctgaattttatgtatacaaatagaaacaccttagaccatctatatcaaccaaagtgtgatggctcctttttagaacattttcttttagttgtagatttattttagtgcttccaattgggtatataacctggagcacttgtgttagcagatatgtagttatgaggagtcagcaatgtcatcgtggtaataaaccatactagctctccaaattttggatttaaaattacagaactacatgaatcaaaacttttcccagttatttctgaacttgtttatcaacagagttctagttgccgattaaaggtgagaatttctacattatacattcaaatgtgcatagcactttcttaagaagatcattggtcattaaggaatcaataaatatttgttgagtgtctgttaaagtgaatatgcagggaagaaaaggatcatcgtctaaagctaactcctacttgccttcctttctgtgttttcaacgttgtgtgtcttagcccatatgcttgtacttgattctaaagttggaatgctacttctaatttctaccagtttcccatgggttcacatttctaacctctgctagatacacaaactccattttagttcagctgaaatcatgctaatttttttcagagagaattatttttgggaattagatttaaaaaaagcttagaaagtattgaaattgactaagagattggaatggaagaagagtataggaatatagtatatagataggagtttacttagtttcagaacattgcagacaaggtatctagcaatattatcagacaagttatgttgtatatttaaaatgatgttaatgtagctctctcaaccatactaagtaaaaactgctgattaattaaaatttgaatgcaaaatatgcaatcataaggtagtagaggaaaatgaaggcaagtgtttctataattctagcatattaaggacctttattagcacgataccatgtccagaaacactaaaggaaaatattgaaacatctgactattaaactgggaatttaaaattcaaacaacgattatcattttgtacttgatagtttggcaaggactagaaaagcgattataccggtgttggaaatagtttggggtaacctggcaaactatcaaaagtaaaaatgcgaaaactacttaatccaagatttctacttccaggacactatctcgagaatataattagacaaagacttaaatacatactcaaaatgttcattgtagaatgatttaaagtaacaaataactggaatcagttaaaaacttcaaaaaggaattgatttaataaattataattcatgcctactgtggaatagtatacaccatcaagaggaatgaaatatgtctctttctatgtacatggcaatgggttcatgatgtgttattacatgaaacaaacaagattgtatagtacaaaattctataaatttaatgtatatgttataaacatacatatacatattaaagttctggaaggaaatatgccaaaatgttcttcagaatgttagtaatgttaatctctatgagtgggattgcaaataattgctttttaaatttctttttgtgcaatttttttcagtaaactataattttataataagaattaaaaatattttccaattttggacaaaataataaatggaagcattttcagaatagatttattctatgaatgtaacaagttcagccagagacacctaatttgtatagtacagagggtggtcttgaaaatgttagtcatttaaattctgtacttgtcacatggattcaggaaacacaagcgttcattggacatttaactcattgtacatacaattattattactataataatttgtgcctgagaagcaaagcatgagatttagaatcagacagatttgggtttgaatgctagttctgcttcttaacagccaagtgactttggcaaagaatataacttctcaatccaatttcctaatatgttttctcatttataaaatgtgttttatacacatacttttcagggtgatcagagagcttataaataacacatgtttgattcatgttaggtattcaataaaatttcgctatcataaatattattgttaatttagttattaagtttattgactgtgatacttaaaattttaacataatggccatgaccatatttaattttttttggctgaaaatcaaaatttacttagggtgagggagaaaaaaagtccagtttagattcattatgtagcagatattttaaaattctgtgttttgtctatgtaaaccccacaaaataatttctctctctttttaaagatctgtcctttctagtgttcttcaatgtttcctgttcatcctcacttccacctgatgctatttcttcttaatccgaagaacctcccttttcattgcttgtagctcagcctgctgaagcaaattctctcagcttgtgtaaaaatgtctttacttttgcaggatattttcatttgatatagaattctacattgattactgttacttcttttagaactttaaagatgttgtttccttgtcttcttgccttcattgtttctggtgagatatcagccactatttatataaatgttttcttgtatactatatgtttctttccttctttctttctttctttctttctttctttctttctttctttctttctttctttctttctttctttctttttgaagcagagtctttcactctgtcaacccaggctggagtgcagtggtgcgatcttggctcactgcaacatctgcctcctgggttcaagtaattctcatgcctcagcctcccgagtagctgagattacaggtgtatgccaccatgccaatttttgtattttcagtagagaccgtgtttcaccatgttggccaggctggtctcgaactcctgacctcagatgatccaccctcctcagcctcccaaagtgctgggattacaagtgtgagccaccatgcctggcctatatattgttttccacttgatgctgttaagattttatttttatctttcatgttatcagtttatgatatgcctaggaatgattttcattatatttgtcctgcttgaggtttgcttaaattcttggatatgtacgttggtgttttcattacatttggaagttctgatagttgtatcttcaaacttttctttctttttttcctttttttgcttccttttctttcttctgtaataagactctagttagattgatgttagagcactagatattgtcccatagatattgggtacagttttgtttgttcctttgttttcattttccccactcttttttgtgtttcagtttggatactttctatttgacttgtctttatttcactggtcaatttctcttttgtgtctaggctgctgctaagcccatctagcaaactgttgatttctaaattatacttttcatttcaagtattttcatttggccgttttgtagacttcatctattggctcaaattcacccatctatttgcatgtattattcactatcacccctagatcttttagcatttatattataggtattttcaaatccctatttgataattccaacatctgggccatgtctgcatctccttctattgactctttcctctctttacaaagggccacattgtgttgatttctcatgtgtcttaaatatttttattgtatgataaacactttgcgtaaaagaatgaaagaggtggaagtaaatcatattttttggcgtttttccctttacaaagaagagcactgctggttctatgagaccttttgaatgggggtgggcagtaggaaagaaaaaataccaaactgacttgaagttgatctgtacgtgggctttactacagttttaatattatttagctcactactggtttcagatatctgtggatagaattgaaaatagttagacacatgtctggtggggcctccttagaattctaatatgtcattctggcctctgtatggctgcttctttcttactccttctatgcctgaatcctctatttcttacctctgagctaagtatgggagtagccctgggtctcgtccaatgagttacatgtccagtaaatgtttgtgtttcctacaaaaggcttattactttctagaatttaattcatttagttttttctgtgcgctctacattttgattggttaaaaaataatgactttagggcttatctggcttgttttggttgttagattgacagcaaagtgatggtcccttacaactttttacatttaaagcagatgttgaactattataacaacatctaatttatacccctttttttctttggcacaactctgtctatacttaactctccaaccctctagattgtttcagctatggctggtcactgactctgaacaaaaaaggtgcatattacttggccccaaagattattttggtagaattcaggcatcgacgttttaattacctcctctaatttttcatggggattttcagcttttgtgggccctaatttatccctgactcttaacttttatatctgtttctttggtttgcctgaaatctgtttactgctaatatttaaaactgaaacatgtttttttataaatctagccattggatcttgtttcactaatgatcatgtggcatcgtttaatctcggtgcccccagcggctctgtttgttcagtttgtatagcacatgcatctcttgtgtttctttttctgtcagatacataatcatattgattagtgtataccccttataccctgagtccaaaaattcctcatccctcccgggatcttcaaatgatttaacgactttccactatctctcactttttgatgtggtctgttccctccttactcaacttaagtttcatggccagttattataaccacttcttttcatggaactggacttccctgccgttttttcttcacttctactatgatcttggcactaccacagcataggttaaatatacccaaagaggacgactcttcccaccttaaactcatgaccatgaacttcctatgtttcctgatgctgccctgtgatcattccatatttccctcattcattcactttcctgtcttatgccaactatttatacattttcctttctcattatcctgatcctcagtgattatattacctccaactttaccataaaaattaacaaaaagaataaaagagcttctatagatttccactgctatatttatccaccactggcataccacctattaatagatctgaccaagaatatcttgcctcatttttccccaatttactgctgtattgtaaaattttcttgtattaatggaacattttcaagggaataaaggcatgttgttatttttccatgaaaaattattcttgaccctcccccatttcttctactagccattgtcttatttatttgctctccttttagcaaaacttcaccaaagtatattcaaccataggagcctttaattcctcttttcaaattccaccatctacagtcagactttagctcaccactgcacttaagctacacttgtcaaatctctactcaccttcacattataaatctaatagttaatttcaagtctttatctttttgacctattaacatcatttaatggagttgatcgctccttcctccttggtatacgttcttcacttggcatctaacactccatcatctctctgagtttctagttgctgcgtctcagtttgatttactggttcctcttcatctacttgacctcttagtattggtaccccaagccttaagacttagctctgctcccgtgtctacagacactcactcccttaaagatcacctccagtcttatagctttaaatgtcatctaagtgacttgacctccaaatataaatctccccaccccagcctctttcctgaactccagacgactctgttacatgtatcaaactacccaaagtctccatttgaatgtttaatttacatttcaaaattaaacttactttttttcaaaatggaactggttttcttaagctctctcactttgatccatatactacttcttccatggtcttcctcatcacaagtgaaggcaatttcatttttccactaagacagagaaaaagatttggagtcatccttgtcaattctctttatctcatgttcaacatttttttttttgttttgcaaaatcttgttggtgttagaatcaaaatatatccagattttgaatccttcttagcacttccactagaatcatcccagtccaattcatggttgctgctttgccgggattactgcattgtcttttaactacttccaggcactccgctttattctcaacacagcagccataattgttctgttaaatatcagtcaagcatattacttctctgctcaaaatgctctattgtttctccattttaccagagtgaaaaccaccattcttactataacctacaagacctaactgagctaacagcagttacttctctggctttatttcttacatttgtttattttgttctccttgttttacacaaattggcctctttgccgatttttgactatgggaggtgcacttctgccttgataccattcgctgttctttcaacctggaacttttcacctcctgatatccatcaggctgactcccttacctgattaggtctgctcaataccagtttcttaaatacatctttcttatcaccccgtttacatctgcaaacaccacctccccactttgggtctcattatgttgctctattcttttccatagcacttagcatctttaatgtattatagaattgacttatttttgttgaatatatctgtttttccctctataatataaaagagaaagcaagattttttttatttgcattactcactgatataccccaggatccagaagattgcctatcacatggtagctactcaatacatattttccaagtaaatgaatcgatgggcagcttccatgcagcattaagcctgtgggtgtgtggaatgcaagaattgaagcttgggagcctctgcctagatttcagaggatgtacagaaaagcctgggtgtccaggcagtggcctgctgcaggggcataaccctcatggccctagaacctctattagggcagcgaaaaggggaaatgtggtgttgcagtctccactgagtcccctctaggacattgccttgtggaactgtgagaagagggccaccatactccagaacccagaatggtagccactggcagctttcaccctcagcaaggaaaaactgcaggcactcagtgccagcatatgagagcagccactggagctaagccctgcaaagtcagaggggtagagcttcccaaggccttgggagctcactcctcccaccaatgtgccctggatatgagacgtggagtcaaaggagattattttggagcactaaaatttgatgactgcccttttgggtttcagacttgcatgggggctgtagcctcttttgtttggctgatttatcccgtttggaatggaaatatttactcaatgcttgtatctgaattatactttggaggtaaataactgggttttgattttacaggctcataggtagaagggaattgccttgtctcagatgagactttggactttggagttaatgctggaatgagttaagactttgggagactgttgggaagggataattgtattttgcaacatgaaaatgacatgaaatttgggaggggccagaggcagaatgacatggtttggatctgtgtccccatgcatgttcagttgtaatccccagggtggaggtgatacctggtgggagatgattggattctggaggtggatttttcatgaatgatttattgtgatagtgaatgagttatcacaagatctggttattttaaagtgtgtggcacctcctcccactttgctcctgctttccacatgtgatgtacctgcttctccttcaccttctgccattattgtgggcttcctgaggcctctccagaagccaaacagatattagcactatccttcctgtaaagcatgcagaactatgagtcaactaaccctcttttctttctaaattacccagcctcaggtatttctttatagcaaagcaagaatagactaatacattatcctttgttactgatgtctaaaaatcttttttaaaaaaattaaaagcaagtatattaagacagtaaaggaataaaaaatggctactccataggcagagcagccccaaggactgctggttgcccatttttatggttttttcttgattatatgctgaataaggggtgggttgtttgttagttttccctgaaaggggtgggcaattcccagaattgaggatccctccctgttttaggccatatacggtaacttcctgatgttgacatggcatttgtaaactgtcatggtactgatgggagagtatcagtgaggacaaccagaggtcactcttattgccgtattggttttcgtgggttttagctggcttctttactgcaatctgttttatcagcaaggtctttatgacctgtgtcttgagccaacctcctatctcatcctgtgacttaggatgacttaccctcttgagaatgcagcccagtaggcctcagccttattttacggagcccctattcaagatggagttgctctggttcaaaagcccctgacaattaccccctcctttttaaaagaaagctcttaatcttaagagttgtagagggatgaagatccatcttctctaacttcttcaagctgaataggggtgatgatattcctgcctaacaattagggtctcttgtctttgggatagagaggaactcaatcagaaaatgctggtatgtcaaggtccattcagaatacttgagttctgacaaaagttgatacctggaagattaataagtatttaatttaagaaaacattcggtaagcttatcctacacaaagagtataacagcaatacattccgcagcagtaaagcaaaataaataaaattatcacaactaaactaaattagaagactttccatgaactgggcaattgttagaaccaagctaatatgtggttgctagtaaatcccagtatgtgcccagaattagaatattgatccagattttgacattgcccattcattttggttttttttgaatagtagtcagagatcacttggtggtacacagaaataagcagagtctgtctaaattacagaaaaaaaaccttaaacacaactaatgagactagaatctaataacaggtgtaccatagtttttgaagcaattctttttcttttcagtctctcatttttactaaagacaaattataatagaatcgatttgtgcgcaaaaatgagctttagtcttatacttggcctgattacttgtataaaatgctaaaaaataactatttttcacataggattttaaaattggctttgatggaactttgttccataaaaaggaatctcagataagacctttttaaagctgagcccagccctgggtttgtacaatcaaatacctatgagttgggttaattcctttactcttgaggtcctaagatatcttcgggcccctgagtctatcagaaagtgacattctttacttatcacaggtcaggaaccctgtacagggcatgtgtaaacaaagaatgtgaccagttttcccaaggggtttttattggctttataagtcaagattgattccttaaaggaaagcacaccattccagtgaaagtcttggtaaaataacaaatttttccaattgtgtcctgttacaaaataaaacagatgcttattgcacttatgcaaatatctattgtcataagttaagaatactcacaaatagtttctaaattctgaagaaattaggtagaatcaaatatgccccaaattttgtttacaggagtaaaatttactcaattgttaaaaagctgtaaatagcttaaaagaaaagttgccttggctctgatagcaaaacaaaggatcagcaacattttaagcaaaaagttttaaaagattacttcagctatctattattcagcccatgcagttaactcttgttcagcttgatattcatgaacatttcagctctccatcagtactgaaagttttatcctctcttctaatgtcacaatcttcaaagttattagaaacgtgcattcaagagcacctgtcaaaatcctatagctgactctaaacttactttttaaagaggattaaaacaggtcaacaattttctatggatgacaaaaagttttagaacgacatatattaaagccacaattgataaagaaattttggttagttctgtgacatacaatgattttactgacaattataactattactgataatgtacactaagtcatatcagaattacaggactttcccataattttggaacacaaaccaataacatatttttacaaatacagtccaaagaaagcaaagaccatttcatatttttctatgcttcctgtatgatatttataccaaataacctgaatatgccattttggactttaggccacctaatagctaagagattaattaggtcagaagaagacatactttgtaattttattttggaaagcttgtcaaatattaaaggtttaaaacactggatatcacaaaatataattccaggtcatcataagtcattcattaggccaaaataataactcaaaaatatttaaaggggaaaaacctttactcattaatagagggaagacttagatctccaaaccatctgtctcttttctttcctttcctatataaaatttcttttttagaaacaacctctttgcatagttgggaatatggctaattccacatgtccccaggccttatctagaatctaaagtctccaaagtaggtaaattgaacaattttcaaaagtcaaagaagcagtttctgaccttaaagcatttagtaaacttaatatgtgacctgcctaatttagaccaaatgtctttattttatcaataatttttaaagctgtttttatttcccaaacattcctaaagtcacatgaactaaaagtgattacactttttacttttctgacaaaatatttgatttagacacttattatttttaaaccgattaatcaaagctcttttatatcacatatgcagcacatataaatacacagacagaaaaagatccagtaagatttttcatttttcggtttcttaactggattactggcttcagggtggagccttagaggaacagagccaagaatgcgtgaaatttctaaagcctaataagcaggcacagctggaaggcaaactagatcttcaggaattaagggttccattttaatagcagattctggatcccaaaaagagggaattagcccatctcccatgggagtcttacctctcagtggggagtgggggcatttccataacttctaagtgaccaagagcatgcttctctgatccaaatgtgcaaagagccaagtattccataactgccattagccattctcaaaagtgtatttcctacctagttattgcataccaaagctctttcctaatgtaaagtgatttctgatacccccaaaagtaaaaaacatcagataacgcaatgcgaaacacaagacagccttagattttgagagggatctatccatttccaattcctgggatttcatgaggaaaacagatgttttttctcaaaatggggtctgtggtgctcctttttttcccaaggagtcccaggctgttagaacttaaatatctgcttttaattaagctgacttttaatggtactgctgtttttaaaaagtcctcttaaatttcttattacctgactttagccaggcgaaactgtcaataattctggcttttgaactttatcaaaggtaacctcccaggtgttcagagaaaggaaaattcaagacagaccattgaggggaagagaatcaacaaatgttcatgcgcatatcaaaccagaaaggactcattccctaagctgggaattgaaccctgaacctgggtcaccattgtgaaaagaaagcctcagctactgagctactcactgggcagtttccattgctcttcccagaaggagtctagagcagcagattttgagcttgcaaaggttttaaatgctcaagataattttgtagagctaactatgacatgaacccccaaattcctgttttctggatggtagagacctagagaaagtaccgccatgtggtcacaaggtcaagctcccaaggacataactagccagtttgctgggccgtcttgaacagtaggcttatggggtcctaagcttgtgttctatcctaaggtacccctctttctaacagaaatatacaggaagacaaattcacagtgcaaagtacaacagattcactgtagcttaaaactagcctcacaaatcctttttcacattaatcagaactttacagaggagataaacagtgatttttaccattctttgaactagtttgcacagagagaaagagagaggacagaagtctcactggtaagaaattcttacccttttgctggcatgccaggcttctgggttccctttccctgagcagtcctagtgacccagcttgacgcatcatagccctgggggccaagctgcaacacaaaggaaaattgtctttttttctgtcctggccagagcaaaatatgtgtgacatagacattagccactctgctcagcatccaatatcaaactaacaaggctcaaatttgcccctggttggaccctgtcatcattaatccaacctctgaccagaagtttcaacatgtggtctctgggcaagatggtcaccctgagtaagagaaaaggtaagaaagggaaaggagagaaagaaagaaaagcattggctgcatacagcagggtggggaaggcaaaataatcaaggataccagagaaagaccctcccattgcgcaaaagttcaggctgccgcttgaagggatctgtcatgaagggatcttttccagtagtcccattagctctcaaacatcccccttttgggaggaaaaagctccccaagtcccacattcacatgcatgcctaattatgtcacccacagccatcagcaaagagggcaaggcagattaacccaacgagaatagcagttaatatctcgtattgccaaacccattattagctgagagggactttactgagaggggcctgaaaccccctaaatcttaggaaggactctaaccttcttaagttgggccttgaatccatgttctgtcaagtgtccttgtcttttattaagaggggcctttaaccacctctgtcttaagagagactctaacgcccctaaattaggcctctaacccatttccatcctttacccaagcaaatgtaccccacttacccagagtcagccaataagtgctgaagtctatttcctttgggtcaggggagtctcctccgtgttgtcccttccatggttcaccagaaagatgttaccagaaagaggtccagatccagaccccaagagatacattaaaacaaagcaagttttccttttgaacttgtcaaaaattccatcttgtaaaggatattaaatgttgctttaagctgaaccttgagcaaattaggtggtttgtgtgaccatacatgtatgtggtggcttcttgtttgcaacttcaaggaacaagtattaatagttcagtgtatgatgttgatttgagttgagcatttgcagtttggataatcttaaattttgacagacactagctgtggagactctttctgttactaaatccttttgttttgaagctattgccattcgtctttctcttgtcctttatattttttgtctgtttctttaagcttttattggaaatgtgcataagtaaagaattacttgtgttacttgccaagcaatgcacatttcatagttttaaatctgtaatcagcaataaaaatcctaaaatatgtatctaagaacatcttaaaaaattctttctcactcaagaaagaattcaaggtgagtccatagagtaaagtgaaaccaagtttattaagaaagtaaaggaataaagaatggctactccgtgtagagcagcacccccaatgtctaaaaatcttaacaatgataataaaagcagaaaacatatggtaattttttggcataaaacccttactgcagtgagcattaaaaacaaataaactgctttggttcttcattctagagacatcatatttaaaaacttagatttcattatttgattttcattttgttacaaaataaaatattcttagtgtcacactaaacagagatcagataattaacctgaccccatgatgcataattttaattttaatttcaatttgagttcttaatagaaataatgaaaggctgttatcatattttggttgaatggacacagatctatttttttatggtaccacattgagaatttgtttttttacatatataaatctattaatggtattgtcaaaatactgtcttttttttttttttttaagatgtagtattgctttgtcgcccaggctggagtgcagtggcatgatcgtatcctagtgcagtctcaagtaatcctcctgtcatagcctactgcatagctgggagtacaggtgcacaccaccatgcctggctaatttttttttttttttttttgtagagatggttcttactatgttgtccagtccagtttgaagcaatcctcctacctcagccacccaaagcataggcatgaaccatcaagcccagctagtcttttaagctttgttgttttgaaaataatgaggattattactttgatatcatattagaattttttctaaaaatttaacaagaaattatctttagttctgtataatctgtgggcagctatatctatttataagcatctatgccaattattactttacttctagttgtaatttaaatttgttttagttttcaaggacacagctagtcttaataacttgatttgtttttatttccatttattgagtttagcatttataataacttaaaaaaaattttatttcactttaagttctgggatacttgtgcataacgtgaaagtttgttacataggtatatgcgtgccatggtgatttgctgcacctatcaacctgtcatctaggttttaagccccacatgccttaactgtttgtcctgatgctctctctcccctccccacacctgaaaggccctggtgtgtattgttcccctcccttcgtccatgtgttctcattgttcagctcccatttatgagtgagaacatgtggtgtttggttttctgtttctgtgttagtttgctaaggatgatggcttccagcttcatcagagtttctgcaaaagacatgatcttattcctttttatggctgcatagttttccttggtgtatatataccacattctctttatccagtctatcattgatgagaatttgggttggttccatgtctttgctattgtaaatagtgctgcagtaaacatatgtgtgcatgtgtctttctagtagaataatttatattcctttgggtatatgcccattaatgggattgctgggtcaaatagtatttctggttctgggtctttggggaatcaccacactgttttccataatggttcaactaatttacattcccaccaacagtgtaaaagtgttcctgtttctccacagtctcactagcgtgttgtttcttgactttttaataattgccactctgactgaaatgagatagtatctcatggttttgatttgcatttctctaatgatcagtgatgttaagctttttaaaaatgtttgttgactgcattaatgtcttcttttgagaagtgtctgttcatatcctttgcccactttttgatggggttgttttcttcttgtacatttgtttaagttccttgcagattctggatattagacctttgtcaggtggatgggttgcgaaaattttctcccattctgtaggttgcctactcaccctgatgatagtttcttctgttgtacaaaagctctttagtttaattagatcccatttggcaatttttgcttttgttgcaattgcttttggcatttttgacatgaaatctttgcctatgcctatgtcctgaatggtatcgcctaggttttcttctagggttttaatgattttgggttttgcaattaagtctttaatccatcttgagtcaatttttgtgtaaggtgtaaggaaaggttccagtttcagtattctgcataaggctagccagttttcccagcaccatttataaaatagggaatcttttccccattgcttgtttttgtacagcttgtcaaagatcagatggttgtagaagtgtggtgttatttctgaggtctctgacctgttccattggtctatatgtctgttttggtaccagtaccatgctgttttggttactgtagacttgtagtatagtttgaagacaggtagcatgatgcctccagctacgttctttttgcttaggattgtcttggctatatggactctttgttatttccatatgaaatttaaattagttttttctaattctgtgaagaaagtcaatggtagtttgatgggaataggactgaatctataaattactttgcgtggtgtggccattttcatgttattgattcttcctatccatgacgatggaatgtttttccatttgtttatttcttctcttatttccttgagcagtggtttgtagttctccttgaggagctccttcacgtcccttgttagctgtattcctaggtattttactctctttgtagcaattgtgaatgggagttcattcatgatttggttctctgcttgtctatttttggtgtatagaaatgcttgtgatctttgcacattgattttgtatcctgagactttgctgaagtcgtttatcagcttaaggaattttggggctgaaacaatggcgttttctaaatatagaatcatgtcgcctgcaaacagagacaatttgacttcctctcttcctgtttgaataccctttatttctttctcttgcctgattgccctggccagaacttccaatactatcttgaataggaatgatgaaagaagggatccttgtcttgtgccagttttcaaagggaatgcttccagcttttgcccattcagtataatattggctgtgggtttgtcataaatagctcttattattttgagatatgttccatcaatacctagtttattgagagttttaacaagaaggggtgttgaattttattgaagcccttttctacatctatcgagatgatcacgtgattttgtcattggttctgtttatgtgatagattacgtttattgattgtgtatgttgaaccacccttgcatcccagggatgaagccagcttggtcgtggtggataaggatatgctgctggatttggtttgtcagtattttattgaggattttcgtattagtgttcatcagggatgttggcctgaagttttccttcttttttttttttttgtcatgtctctgccaggttttttgtatcaggatgatgctggcctcataaaatgagttagggaggaattcctcgttttcaattttttggaatagtttcaaaaggaatggtaccagctcctctttgtacctctggtagaattcagctgtgaatctgtctagtcctgtgctttttttggttggtaggctattaattactgcctcaatttcagaactcattattcgtctattcagggattcgacttttcctggtttagccttgggaaggtttatgtgtccaggaatttatccatttcttctagattttctagtttatttgtgtagaggtatctatactattctctgatggtagtttgtatttctgtggggtcagtggtgttatcccctttgtcattttttatgtgtctatttgattcttctctcttttcttctttattagtctagctagcagtctattttgtttgtttgtttgtttgttttcaaaaaaaacagctcctggattcattgattttttgaagggtttttcgtgtctctctctccttcagttctgctctgatcttagttgtttcttgtcttttcctagatttttttatttgtttgctcttgcttctctagttcttttaattgtgacactagagtgtcaattcgagatctttctagctttctgatatgggtatttagtgctataaatttccctcttaacactgccttagctgtgttccagagattctggtatgttgtttctttgctctcattagtttcaaagaacttcttgatgtctgctttaatttcattatttacccaggagtcgttcaggagtaggttgttcaatttccatgtagttgtgtggttttgagtgagttttttaatcttaactctaatttgattgcattgtggtctgagaaactgttataatttcagttcttttgcatttgctgaggagtgtttactaataactttttaaaatatcagtgatttttccaggtaatagacatttatggctttgaaatttcaaagtatgtttaaacaaaaaaattcatcaacaacctcctcccacattctgcatttacatttatcattatcatgtgtgttcttatacttttattattagattgaaaaatatacaattgccattcttatagattaaaaatggtcaaacattggctatttcaaatagttcaatatgtaagtatctcaaaataatataacacatgctgttatctttatgttgttagtatttatgtaagtgctcatatatatatatgcacatatataaaaatacagagtatatcttcaatttgcctttttcataaataatttttctgagaattacccattttgatattttgttcattcattttagtttctctattagtattccactttataaaaaaaagtatggattatgtatttgtttccatgtggagagttagcttttctctttatataatttatagaagattgcaattaatattttgtatgtctccttgtgtgcatttgtgagaatttgcacagaaaaagcacagtgaaaggtatcataggcttcttaagtattcttatcttccattttgatatatcgccaaactgttatctaaagtggttgaaccaatttgccttcctatggcaacaggtaaaatacccatttgcctgtgttatcaacatgttttgttttccaacatttttgccaaaatcatgagtataaaatactcccttattttcgttttaattttaatttctttagtaactattaaaatattgaaacatatggcatttgagttttcgcctctgtgaattgcttgttctggtatatctttcattaaattttccattgcatttccttgtcagtaaaagttacacttataatctgcattttacatgttttaattatattgattgtaaaaatatttccttcagtggtttgacttttaaaattttttgtatttttggtctgtcacacaagagttttaaattttaacattggcgaatatatcagttactttttatggttcagatagttttatatcttacttaagaaattctcttttatcatgatatatattgccttctattttttctgaaattaatttttgtataatgtgtgaggtagagatttaattttaacttatctttattggcacattcttgtcccactgatttttattgaacacacattatttcctcactgatttttaaagccacctctactgtatctcaagctccaatttgatggtagtgtgtttaacatcttgtttcagaggtcaatttgattaacttcttgccaaaagctatagcacttgattatcttttgatatcttgcagtggattccttcttaccagccttcttcagctattgttaggtcttactcctccaaatgaattttaggatcagtttatataaaaatgtttattgagattttttattggaattgaattaaatttatacaacagcttagggataatttatattgttatgctgatttttttcatccatgatcatagtatatcattctatttatttagatcttcttttatgtcttttagtaaatttctataaataaaatactcataacttataataaaagggataaatataaaatttattcctaggtatctcaaggttttggtgctattgtaaatagtatcttttattaaattgcattttatatttattgctgatataaagaaatattataaattgttatatatcattcttatttccaacaccattttggaacacattaattcgaatatttgactatagatttatttgaattgttgaggtagaaaaccatgtaatttgcaaataatatatttatgtcattctaattcttatggattttacttcttttctttgtctgattgtgaggtctagacattcctttaacaatcttggaaaaaaaagcagtgagagcaagcatcctcaacttgtcattgctttaatggaaatggctttacattttttcctttaaataagatgtttgccatatcacgttaaaaactttcccacctattcctaattgtttagggttttctacttgtatattatgtatttttcaagacatggcagatttaatttgttgagatataattttcatgcctatgctaccaagtgagattggtcctgtcgttttcctttctcttaatgtccttgagaacatgtttcagctctcccatttatgacctgttttaccttgggcaaatttcttaatatctatatgcttcagtttcctcatctttaaaattagcatcaaaagaatatctttccatagtgtttttatgaggattaaataaaataatatacataaagcacacagaacagggcctgctactcagtatgcaatagttattagctgtcattgtcatcattaatattaagatattttaaaacacttttcccctaaaatacttagagtactttgatgcatatcctaagatctgtctctggctgctatttctggacatttctttgttgtaatatttctggtagctcttacttgtgactgtgaattgtagacatttgatgcccacagactattcagctctttcaacttctaccttgttcctaaggaaatctgaatcaattcatcagggtctttcctaaagaaatttgtcgaagttatccaatccaatgccacgattatatttcttcttgtatgattgtgtttttgttgtttgtcaaagaaatttttgcccaagtcaaggtcacaaagaattttcctgtaattttttctagctatattatagttttaggttagttctattatccatattgagttaaacttttacataaggtgcatgatatgttttcaggtgctttaaaaaacataagatatccaatattccaggaccgttcttggaaagaagagtattctttttccatttaattttctttgccacttagttaaaatacagtggactgtgtatgattttattatcagcattttcattgctactgaaatgcagtaggtatgcaattgattttcatgtattgatattgcaacttgcaactttgctgaactcatttataattcctaatagattttagtagatttcttagagttttctatgtacaagagatagttttacttctactttttcaatatggaaagatttatttcttctgcttgcctatttgccctgtctggtaactacagaaaaatgttgactagaagtggcaaaagtggacattgttatcttgttcctgatcttagggaaaaagcattttttcaccactaaatatgatgttagctgttggtttttcacagataccctttattagatgaggaagttgtcttctttaatagttagttgctttttaaaaattttatcatgaagtgttaactttgactatgtagctattaagatgatcatgacgtttttgtcctttatttttccaagtttgtgtattacttgattacttttcgtacattgaaccagccttgcatccttgtgataattccacttgctcatgatgtatgatcctttttgttagtactgtatttggttcactagaattttgttgaagacttttgcatctgtattcataaggcatattggcctatagttttcttttgatgtctttgatgtttttggtattagggtaatactggtttcatagagtaatttggagagtgtttcttcctcttctattttttggaagggcttgtgaagtaatggtgctacttcttctttaaatgtttggtagaattcgccaatgaaagcatctggtcctaagcttttctttgtggaaatttttaaaaaattactaatttgatctcttttagtggtatagatctattcagattgctaatttcttcttaagtcagtttacatagtttgtgtgtttcttggaatttgtctattttatctaggttgtctaatttttggcatacagttgttcatagtatcccttatgatccttttttgtgactgcaaagtcagttgtaatttcccttttttaattcctgattttaatcattagagtcatctcttttcttggctagtctagttgaatgtttgtcaaatttgttaataatttctaacaatcaacttttgttgtttttcttgttgtttttctattctctattttatttgtctgctcaaatctttataatttcctttcttctgctagctttaggttgagtttgtttttctttttctagtttcttaaggtagaagattaggttattgatttaataaatttctctttaaatataagtgtttacagctctaaatatcactttaaacactacttaaatcccataaagtgtgatatgttgcatgttcacttccattaatctcaaaggatttttaaatctttttgtaatttcttctttgatcattagttattaggaatgggttaattttcacacatttgttaattttacaaatttgcttctgttattgatttctaattttttctattgtgatccaagaatatactttgcatgatctcagttattttaaatttatagagacttgttttatggcctaacatataatctatcctggagaatgtaccatatgcacttgagaagagtttgtattctgttgttgttgggtggagtgttctgttggtgtctattaagtctaattggtttataaagtcattcaggtcttccatttctgtttgtattctgtgtagttgctctctccatgattgaaagtaggatattgaagtctccactattgttgttaaatggtgaatttttctctttaaatctttaaatttgtcattttactgttgttagacacatacatgattataattgttttattttcctgatggattgatatcttaaaatattcttgtctctactaaaaattttgtctaaagtctattttgtctgatgttagcataggagctcaagctctcttttggttattgtttacgtggtgtatctttcttttcattcttgaacattcaatctatttgtttcctcgaatgtagagtttgtctcttgcagaactcctatagggggtcatgtttgtttgtttttccattttgtaaatatctactttttgattgaagtgcttaagccatttacatttagcacagtgactgataaggtagttacaatgtcactttgctgttggttttttaaaatatgatttatgtcttctaaatttctctattctttcactgtcttctttgggttaaaaagttatcttctagtgtataatttaatacccttgtcatttattctactatgtttgttgcccaggatgttatcattaacatcttaattcataaaaatctaattcaaattaataccaacttaattttaagagtatgcaaaattttgcacctatatagtttttgttcactctgctttcttttgtgccgttattgtctatggagattttttacattggatgcccatcaacacagatatataattattgctttataaagtcatcttttaaaacaaatgtgagagagaaaaagaattacagtaaaaatacatttataatctttttaaatatttacctatttaattacctttacaggtactctttatttcttcatctggattacattgctctctaatatcctatcatatcagccagaaggacttcttttggtatttcttgtagagcaagtctgatagtgataaaacctctcaatatttctttatctggaaatgtcaatttatcctgcatttttgaaggagagttttgctagaaaaaatagtttttggtgtacagtttttttttacgactttaaatatgtcattcttctcccttctggacgccatggtttcttcacaagaaatctgtggttaatcttattgaagatcccatgtaggagatggccttttctcacttgctgctttcaagattttctctttgtctttgtctttcaacagtttgatttttaatgtgcctagggtgtggatctatttgaatttatcccacttgcagttcattgagcttcttggatgcatagattaatagttttcatcaaattttggaagtttttggtaattatttctctaaatattctttcagtccttttacctcttctctgaaactcccattatgcctatgctggtactcttgatggcgtcccacagctttctggggctttgttaatttctcaacattctttctctttctattgctcacactgaataatctcaattgacctgtattcaagttcattaattatttcttctgatcatttagatctgctagtgagctcctctagtgaatttttcatttgaaagttttctattttctatttattttttctttttttgatgaaatgaggtctcactacgtttcccagggtggtctcaaactgctgggctcgtgatcctcccacctcagcctcccaaagtgctgggattacaggcatgagccaccatgcctggctaaaaattttctatttcttttctcatattctatattgtctaaagcatcattgtcatactttgctttagttctttggacactttgttttgttttgtttttagttatttgaacatatataaaatagttgatttaaagtctttgtctggtaagtttaatgtatgagcttacaattgacccatttccattgcccatttttcttcccctgtatattgtttgtaggagtttctttgcatatgccatattctttgttgaaaaccagacattttaaacacatagtgtagcaaatctggaaatcagattatttccctttccagagttgttttgttgctgctatttgtcactattactactgtttgcttgtttagtggctttcctgagctaattctgtgaagtctgtttctttgtcatatgtgataaatgaagtcattgtttgctcatcttagtagtcaggcaatgactgaacagagaatttcttaaatgcctagaaccaatacattttccagtctctggtgagagatctgtacgcatgttgcagaatgccatcaacactgaggcagtttaacactctcctttagtccccacttcctgcttgtgcagagcctcaaagtcgagctgaggtgagaccttaggactttctcaggtctttctttagcatgcgcatatacctgagcacatacttagccttttgcatgttcataatcttgtagattcgcaggcattttttaaggatttgcaaagcgtttatggacatgatgtttcacatcttctccttttaagtattttggattgtttgttgtttcttctgactgttgttactgcctgggtcaactgcaatgttaagcagttgccagtgattatttttagcaaataattgttttaaacaaacagagtaaatgctgtttccagtggatgaactctgagtcaattcaagccttactagtggggctttccatggtacttccaggcagatcgaataatgacaatcatctgaggatagagctttgaaacagctccactcccattctgatcctctagcagtaactaggctgctggttttcaccctgattgcaaactgttcattttcagggcttccagagagtggcagagaggagtacgggaataggaaagctaaaatgccatagaacatgttgttcttaccaatattcagtcatttaaaaaataaacactgtccacattgttgcaagtctttgctttatttccagagttctcaataagttgatgtgatattctttgccagtgttcccattgcttttatggaagacagactcttccattgttttcactctgccattgctgatgtccttttattcgtttcctcaatgtcttatagtttttacctatatacattgccttgctttaatagatttataactaatatttcacattttcagtgctaataaaatagtatttaaaagttttaatttccattggttaatcactagtatatagaaattaaattattactcatttaacttctatcaaacaaaattaactaattcacttgttatttctaatagcttttatgtacagtcatggaaattttctgagtagataattatgctatctgcaaatgagagtttatttctttccttctgattgttgtgacatttgttacttagccttattatctgtttttaccctgatttatatgttggattacttagttttcccatttgactaattttgttgtgccacccagttgtaatgcataacaacttctttccagtcatcacctgtctattttctgactagacagctatgaggtctttcttgtatgagtcatgtctatttccttgatcaatttatataatttagacatatctttgccatatgaatatttttcaaagaagaatttttatggaatgtttatcccaatgaatatctgttgttaaaaaattggcaagtagcaaaggaataagtaaaatttatttctatggctgtccttgaaatatttgatagtattctcacctcaaatcataattcttttatttgggatggatgattcacattaactctaggtctttagaaaacttgctgtaactcttttttatgaagaatttcttcaaatatgaattctttagcaatggatatgattgcaagctccaaaatttaaaactaaaatggtttttaaaggttataaaacccagcccctttattttatagataataaaatagatttcattatccccctgcagcagagcttccctttagctattattaaaatatagggagtgaattctaatttatcagcattgaaaggtacacctccacttctaataccctggtctgactgccaacatttttcacacatatgactgtaatatcctcctaactggcctcttggcttctactcttatcttcctatattctagtctcagaacttttgaataatcctgagatcacatcactcctcttctcaaaaccctccaatggcttcccattttactcagaccagaaatcaaatttcttacagtaggctattagactttgtatatataacaatttgtacctccatcctcccctctcccccagccagctacttgtctgacctaaccttctaataacctccccccttttattctgctccaggatgctagctccttgcacctcctctaacatgccaagcatactgatttagaggtctatgtgcttattaatgcctgcctggaacattttgcccctagatatacgtatgactcattcccattcccctgtcaatgccacattctcaatgaggcctctcttggacataacatccccactaaaatctagccatgctctccaacctgctctaatccttctgtttttcataaaatgtattgcattctaatatactatatgaatttctcattcattatgtttatctacgtgaatgcaagctccataaaagcaagggtattttgttgttgttgttaactgattgtacttttggcactcgtgaaagtgcctggcacataataggcttccaataaatacttgtgaatgaatcaatacgtaaaagaatgaagccaccctgacatttaaagccatggttcaggctttagcaacatcacagtgttcatcagttttgctgtctttcagttatggtaagtctttcaaaattatgaatggctagcccctgtttgttatgatctgggttctttgagataaaacacttccctagaggttatataaaatattttagacaatattttatcctgagaaagcaaattggataacatgaaatgcaggtaatttctttttttctccttgatatctcattatgttggcaaaaataggaaatgaagactgtcagttttccacggctgccatgcaaaagtactgcaaactgggtggcttctcccagaaagagaatgcctaggactatagcggggcacagaaagttccccacaaggagtatttcaaagctgagacattaggggctgtatgaggcagaaaaattggaagcagaggcaaaatgggaaccttagggctgagagagcctgaaggttgtggggcattaaaaattcatgctgtagattaacagtgtggggtgtaaaggatgctaggagaggaagaactgagcatggttagggatagttgaaggtaaagaaaaaacgggacacaggcccagcttccttgacaacattatctcttacctcataaataaaatttatgctatgaggagtgactttcctattcgtctttcctattccccaaataaaagcataggcacacaatggctttgctgtatttgcatgtattcttctcatctttcttctaagaatgacatgtccatctttctaccattccctctttgtttaactttagatcctggatccaggtcaattgatcataaatcatgttgcctggatggccaattaactgaaagaatattttaccatgttttcttatttcttgtaactaattataaattttagaacaatttgtgttggaaatcttctaaagatttctgcaaagttttagtagatttagttttgtcttcataacaccacttggaggaataattctttgcacttgtgccagctgcctgttttaggatagatagagtagagaaactctccctacgggaaagtcagagcaggaggctgcctagagcacatcttcttgtgggcctcagctcatggggtatgtggaagactgagactaatgggtagaaagagagagcctataagtgtatttttcttagactacatcagctgagaatacactaatgaagaaatatttttatatgtaatattttggttattttctcaaatatattatttaatataaatataacatgtaaatatatgaatatacacaaatatatgcatacacacactcacacacagacacatactctttttaggctcctaagtctcacactttgcttgtgagtttcttcctgattctgagatcactatctcagactacttcgtgtgctaattctcctctccatgttttatttatcagccatatcctcactctgtcccagtttcctccaagcaaccaccaaggagcagcagaaaacataaatcaaacattctttaaaactctatcaagacagagtgaaaactgaatagttaaaagaaaaaacacattgggaaaatggtcatttgatgattaaaattgctccaattttatttttttagaactattgaaataaacaattattgaaataaattttgttattaaaaatataacaaaaaacttggagtcggtagtttttctgctttattctgtctccactctcttgggcttatttgtctcagtaagttctgaaaaaatatttgccaaacaaataaaataataccatgtggattaaggttgatagctacatttgccttgaaaggtcacctaattcaaagtagattggtctttgaacctggttttcttagaagattttccctgaggcaataaaattctgagagtgaactatgatactattgatatatgtgaatgacacagaacctacaagtaggaagtcttcgatgagtcctcatttggagattttctagaacagacattaatttaactttagagagaacccaaacagatagcctggagcttggagctataacaggtgggatgtgagagtgaggaatcttccttttggcattgcaaatactctggaaattgcaatcagaagcagatgacaatcaaatttagggctgatgagataatatatctatggagttataaactagagagaaatttgacttgggaagggacttctggagaaagccatgagttcgatcagtaaataggctggccaaagtattcactttgacttaagtcctacagtgtccatggagataactatgattatttttgttattaatgtggaattagcaaactagagattgatctgtaaaagtttcaaagggcagtgacataaatatctttttaaccttaacatcttcaaaggaatatcacttaaatacttgtcaggtattgcttggtaaacagagacttcttatattatgcacatgtgtgtatttgcaggtttagagcagtttgtcggaagaatgcaagattttcgattataccaagtggcacttacaaacaggtaagcagatgttgcattgtaaacctcaagaaccgaaaggataaatgctgaattcacttaaataagaatactatgtagattataccattttttatctttataccatttggcaaacttcacctaattaatgtttacagtgtttgctttggcttagtctatggttgttattcactagtgctactcttgaggaactccttgtaatatgaaattgatcacatttttcctaaggatattctgtaagaaaacttgatatttgaacattttataaaacttgggatacaatgcttaaattttctatatgaggtagtttctattaacaatacttgagaaacttctacatctgccttttttaaattggtttgttgactttatacctactagagaatgtagaacaataaacgtgattaattattttgatacatgggaaattctcaagagactgatctattagacttggagacaagaagaatgagcatttgaagtattgtgatatatttttctattttcagtgaacaaataattatatagactcaggctagctttaatgacattatttccttatcttgagagtagatgggaaatctttcttagggcttcttaaaagcacacagaattttaaaaaatttaagtgaaattctgcttaggatgcctttgaactttcttcttcagcttatgatatcatggtataatagtatattgttgtatggatgagttgatcttatttacttctattaaaaatcaaaaagaagaatgttcattcatatttcttcaaggcagatataaattagtgtggtgggtttccaaatgagaagactagcccttgtaaatttagaagcattgcttttgatgtggttcttagtccatggcagatcattaacaatataaacattctttcttaccaggctatataatcaaggtatgcctcagtaaagggtgccatggccctggaacacagtgttaggtgtatttactgccaaaagccttactatattttagatcacctttgtctaaaatgctgaagggcaatgttgtagtaattctttgggaataaagtttttccttgggagtgaaagattttatactggattctatactggtagcttttggtcccattcaaaacttggtatcagttgaaaagaattgatgagatttaaagaaggtatgacttcatgtgatttaatgaatggaaaagctgcctgactccttcactgctccactggggtctgagaggaaaagcctggtttctctggtaagaccttgattactaattttggcctacctgaaatgtctgggaaggtgctatgtggaagaatgcctataaatagaatgactaattctggtctagaacaagtatattgcccctaatggaaaaattaaatatatctacctggaattggcattctttgactgttggcagccgccatatgatctgaagccaatgaagcattacaggatgtcaggatctgtactgatgagtcacaggaaaccattgacaaatggccttggcctcagtccttcacttaaaacagaagcagataaaatgatacttgctttcgtacttctttcccatggatgaactgaaaacattatctataactctcattgttctccatatattattgttcactctcagtagttagtttagcatcctaagtaaatgtgatcatttctatattatcacaaatagacacggtaaaatattgtggtatttaaataagtatcttaataatcagacaagggcttatgcatgcttcttgatataaataaaaagttaatattaaaatgtgtgggttttgatatacattttatgataatgaatttgtttatttggccaaaaataagttttattttatgtttcatgcatcaaattattaaaactaaatggatactcatgaaagcactaaacgagtgacattcatttgtaacgactcctagaagttctattactgttaagctctttgtccttacagtctccctcttgactcccacagagagattctggaagtcttctctggagatcttctcagattgcatgcccaatcacattgccgttgccctggcagccacccgcgggtccaccctttggcacagcggtactgcattcctaatgatgcaggagacacagctgataatagagtgtcacggttgaatcctgaagcccatcctctctcttttgtcaatgataatgatgttggtacttcatgggtttcaaatgtgtttacaaacattacacagcttaatcaaggagtgactatttcagttgatttggaaaatggacagtatcaggtaatgagaaacgataaggtgtacattaatttcctgtggttattgcaacaaatgcccacaaacttcatgtcttaaaacaacagaaatatattccctaacagttctggagatcagaaatatgaaatcaacatgttggcagggctacattcccttaaagattccagaggaggatccctccttgccatttgcagctcctggtggcccttggtgttacttggcttgtggcaccacaacttcaatctctgcctccattttcacatggtgtccttccttgtttctctgtgagcatcaattatcccttttctttctcttatataaggcccaccctattagacccaggatgatctcatattgacatccttaattatactgcaaagaccctatttacaaataaagtcacatttacaggtttggacagtagtacttggacatatctatttgggaacacaattcaacccactacaaggtgaaaactgaactaggcaattgaaccttgcctcaataaagtagtgtattataatgtatacaataaaaatatctaaaagacaacatgtaggaccttatgtttgagatttgtatcaaaatgatatttatgaaatgttgaaaataattatttttattaagtagcaaaaattaatacaaactaaggtgctttttctaaattaagaagtctctatatatgacatttatttcatagaagtaatgttctttgtttatgtctttatttgcatgttgatttataaaatccttgagcaaatgaacagatacacaattatagaatatgttgcttttaccacagggctatgaagtttctggatgtctaatacatatttgataactataattatgatgaagtgagccaatatatttgaatctaataattccatggtttgatatatactgatggttaaacttaaaactttaattacattaattaactttccattttcaggtgttttatattatcattcagttctttagtccacaaccaacggaaataaggattcaaaggaagaaggaaaatagtttagattgggaggactggcaatattttgccaggaattgtggtgcttttggaatgaaaaacaatggagatttggaaaaacctgattctgtcaactgtcttcagctttccaagtatgaatatttttaaacaattaatttaatagactgattggttattaataatgtacaagtatgctagctctctaggctggtggagacttcccttcaccaccaacttccttgaggcagattctcctaagtcttatccctaaattgggcttaaaactatgtttaaagttcttgtaaaagacattagagtgactcttatttcaatctcactgatgtttcacaatctgattttcagattgtttggcaagttatctatgtaaatagaattttcattatgttttcaaggaactgttttagtgtggctttctatgataatcctgtattgtttatatatgaaatatatggaatatgcttttcctagaatgaataatttaagcttttattgatactgtgtagtaatttctcaacattttgatttctgttttgccaaaaatgtgaatagattttcatgacatcgaatttctttcattaacagttttactccatattcccgtggcaatgtcacatttagcatcctgacacctggaccaaattatcgtcctggatacaataacttctataataccccatctcttcaagagttcgtaaaagccacgcaaataaggtttcattttcatgggcagtactatacaactgagactgctgttaacctcagacacagatattatgcagtggacgaaatcaccattagtgggaggtattattatgaattttgttttcaacaaggtttttgtcatacttactgtcttaacagcacattaagatgtcagagcaagccagatttcaagctttacattttgaaatgatttcatactctaagattttaggggaagatctgtatgtgagtcttttctctatataacattgttatatatatatatatatatatatataaaacgtattttataaataaatatatatatatttatatatacaggaattgattttcaaaagctgttgcttttagaagctatgatactctgaatctgacttagaagtgatttatccaatattttacttgatttgttctggaatataattttcaaatattctcaaaagcaaagagatggagctgaatttggagttgtaactatagcaccagagagtttttaagtacagatcttgatctacctgagttcatagtgcacagttccatgggtaatacttgtttttctttagtggaaagatctgatatgccctaagtagtttataaatgtctgatcataattgagaacatgactcacaatatttaaaaagaaatgacagctgcaaacctaggcagcatactgtctaatatagaaatgtacatatagagtatatttagaatggattgttctggaggaatgataggccttgtgaataaaatatgtctttaaaagcagaccaaaataccagtatataagcattgtttgtttgctaagtcatagcataatgaacaaagcaatactattaaatattcatcatctaactttggaaaaaaaaataaaaaaattgaaatatgttaactgcattctgcagtttattgtcaactttatattcttttttctttcttttttttttttttttgacaggcttttgctctgtcacccaggctggcatgcaatggcatgatcatggctcgttgcaacctcgacttctgggcctcaagtgatcctctcatctcagcctccaaagtaactgggactacaggcatgtgccaccatgcccagctgattttttttttcactttttgtagagatggggttttgccatgttgctcaggctgctctcaaactcctgacctcaagtgatctacccgcctgagtctcccaacatgctgagattacaggcgtgagccaccgtgctcagcctgaactttatattcttaactgtattttaaatagtgtagtaaatgccttcccttggtacgtggttggtatagatataaaaaattccatttccctttagaggttggcttgaaaattatctttacaatacacgggtttggatattggtgacagtccttctgacatttccagataaattaaaaacgtgtatggatatccacacgattaaggagaaactgattttgtatcaattaaatatacaaaaatcttccctgttaaattcacataatgcatatagtcctaggaccttaaatatattcacagttgagttggtgttccttaggagtgtgtgatgctcatgtttgcagatgtcagtgccatggtcatgccgataactgcgacacaacaagccagccatatagatgcctctgctcccaggagagcttcactgaaggacttcatgtgagttctattttatgcatggaaatctaaaaaaaaaatagtagagatggtgactataaattctatgaacttaatcttggcctaacaaatgaaaataaatttaaaaactgatatgaacttaaaatgtcaattattgcagattttttaagaaaaataacagccatcaattaagttgaaattgtagtttttaaaaataatttcagccagagaaattacaactgaaaccaaaccctaaggttcttttctcttttgtttttctttctttgtttcatcagcattatcatgttttataaaacaatttttaatgtgtttggatagcatggcactaaacaaaaaatagtttgattcttactaaagggtatttatacaaaagtatcaataaacaaaagcatcgttagatgaagaacaatgtttatgtatttatgtcaatcaaggttcatttattgctaatatcaggcattttaattaattgaaaatctatagtaaaatgatttatgagttatgttactttagttttctgtgacgatcaggggaattccatagttgaggtggaattttagcttcatctttagggaaaagaggtaagtggaaataaaatcaagaaacattcgttggtaggaatatctagcaacaacatcagaaatagctgatatgaaagacggttcagcagcagtaacaattataccaataatgagagtagataatatagactcttcagtaaatatgtttaagacaactggctgctaatttgcaagaaaataaaattagagctctactgattgtatgtacaaaaatgtatgtggcttaaacttttagtgaaaaataactataaatatattaaaataaagattagaattctatatcttaagttgagggcttttatcagctaagcaaatgaaatacaaacagaaacaaacatctggagctatgaaggaaattaatgacatattctgttatataaatatttaaaattctacacagtataagggttaacataaatgtaaggtagtgataaatgatggattgatagaaaatatttgcatcatgttaacaggtaaagagttaagattcctaacacacaaacatttacaaaatattaagaaaaatataacagtctgataaaaatgagcaaatatatgaacaagcaatttacaaatgaacaaattgtaactttaataaacatataaaagattacccaacctcagttttaatcatattcaacaattgtttttaacatttcaaattagcagaaaatataaagattggtaatatttagtacttgtgggaatataacctttaacacatcactgatgggattgccaattgacacaatagttttggggaaaatttgtccacctctactaaaattaaattttcaaatatagtgaactacattatataattgctgtcattctgaaaagcagttcttcaatgacaagtgtatggaatggtgtattagtctgtttgcattgctgtacaggaagacctgagactaggtaaatataaagaaaagaggtttatttggcttgtggtactgcaggctatacaagcttggtgccagcatctgcttggtttctggtgaggcctcagaaagcttacaatcatggcagaaggcaaagccagaagccagcctcttttaaacagccgtgtctaaacagccatgaactaacagagtgaggtctcactgctgaagggaaggcacttcatgaaggatccacctccataacccaaacatctcccaccaggctcacctccaacactggggatcacatttcaacatgagatttggaggggacaaacatacaaactatataaaatgcttatatttctatcattttgttacataaatatgggcttatatgttagtgcattttagcttttcagatggtagcactgtctcatacactcatgtatgacttgtgaacatctctgcctcttggaccttgccctacacttgtgttttagttagttacttcacttctctgtgaaatttattttaggatattatagagcatcttgctttttaaaaaaccatctgtaaaggttttggcaaattccatttctgtcttctgattcttactctgatctaatttgcttttgactgtaacattagtgagaatagttcaatggtaagaatattatctataatgcagactttctctagcacattcaaaacgtagtcccactcctcagtttcaactaagagtctttgatttagttatggcctactttctttctttctttctatgtgctcagaccaaaactttcatgttctaatttagatattcttttgaatttattttctagatcactactttatatacatctagtcctcaccattagtcaatacttgctttaaaagaagaaatcttttatggttttcttttggatttctaatgcctagagtctttgcatttgatttcattagtatattatgaggaaaaatcttttagaagaactgattttaatatgcttgattgtatggcttatcatattgtcacagaaatgaaattaattggattaacttgattgatttattcttcactgagccataattgtgtgtttaaatttttgccaattttatttgttctagattttaaagttaaagcaacatttattatatttttctactgtcttcttttgatcccttaagatggacacttacttccttataatcagtgatttctttcattaaccttgtcctctcctccacaaagccactaacaccccaattaaaaaatgctttgggatgaatttagcagggcaccttgaactgaatatgtctagtatttgcaagctacagtttggctaataccttcatatgatatgttcttttctgagcttctcttgctttctgttgactagtcagtcggtattagtctctctcatttgcttgtgacgtcctgtcttgttttatctttctgtctttaattgctcacagttaagtgttggatattttctgattcttggatgatttcatgcttccccttaaaaatagagccattaaatgaatgaaggctcatgattggtttcagaagacaagttgggattttcagacttggtctcaggtggtgaatgttggattatgaactagtgaattaattaactataatttgggttgagaatacattttaatgcttcttatttagaccttaagtaccttttgaaaacaaaaatgaaaaactaaactttttttgttattttcctccttgacatattttgatagtttatgaatttagccataaattttaaaaagcaacaaatataatttacttagcaaactttggcaaatgcaaatgcagctgcagggaaaaagtcaatagactgttaagttgaatgatttctcagtcctatgatattttcaataatgtgttgaaaatgaaaaatgattttatagaaacattcataggcatgacattctcctttgttaccattcaaagtattttaatacaagtagagacttacatatctgagaaaagtcgtcttacggtaatttgaaaatatacctattctaatgcttttcttgttgttctactttttaaaattatacgttttaatataagccattcacttcctattgggatccatgttctttttaagacctggacataatccaaaaagaatgtcttcaattccacagtgttatgctatccattaataatattacttaataaacagggcttttgtgaattatattacagacatttggcaaacagatgaaaatgtaaggactgaaaatatgccaattcttggcaattgtctttcctatgagaaagtgtttttagtagaaacaaaaatgaatgaagttgagaaaaggtgaatggtgaattcaggggcaggttcacatatttagccatcctaaggaattttccgtacaaaatactattcatttgtttataaggtcaatgtcacaaattggtggctcacaggtagaaacagtgtttaaacagttttaatttaattttctgcaagagttttcactttaaaatatttatttattcttcaatcttttttatttatttatttttttgagagggagtctcactctgtcaccgaggctggagtgcagtggcatgatcttggctcactgcaacctcagcctctcagcttcaagcaattcttctgcctcagtctcccaagtagctgggactacagctgcacaccaccacacgcggctaactttttgtatttttttttttgtagagatgggtttcaccttgttggccaggcaggtcttgaactcctgacctcaagtgctccacctgcctcggactcccaaagtgctgggattacaggcatgagccaccactcctggccctcaacttttattttaagttcagaggaacatgtgtaggatgtgcaggtttgttacttaggtaaaggtgtgccatggtggcttgttgcatagatcatcccctcacctaggtattaagtccagaaaccattagctattcctcctgatgctcttccccccacagcccccaccatccctaagaggccccaatgtgtgttgttccccgacatgtgtccatgtgttctcataattcggatcccacttgtaagtgagaatacgtaatgtttgattttttgtaccggcattattttgctgagaataatgacttccaactctattcatgtccctgcaaatgatttatatttctggtaatacacagtaatgggattgctgggtcaaatggtatttctgcctctagatctttgaggaatttccacactgtcttccacaatggttgaactatttatactcccaccaacagtgtaaaggtgttcccttttctccacaaccttggagcttctgcacagcaaaagaaactatggtcagagtgaacagacaacctatagaaggggagaatatttttgcattctatccatctgacaaaggtataatatccagagtctagaaggaacttaaacaaatttacaagaagaaaacaaccccattaaaaactgggcaaagaaccctgagttagcgagttgttgccaggggaggacattaatgtcttcttttgagaactgtctgttcatgttcattgcccaatttttaatggggttgtttgtttgagaacagttctcaaaagaagacatatgtgtggccaacaaacgtatgaaaaaaagctcagcatcactgatcattagagaaatgcatatcaaaaccacaatgagataccagctcatgccagtcagaatggcgattattaaaagttaaaaaatgacacaaatttttaattcctcacttctcttaatcagaacatagtctaacactgtgtccatttcctgccatcaacaactcactgattcagggtgacatttaccacatttacaacagtatcactcttgggcttgctacaacattcactactatgtatatccttatacatgggcgacatcactttggtgaactacctggccttgaaagactcggagcttcttaacctcctaaagcaaaactgatggatagattgagacactagaagctagaatacatttttaattattctgagtagagaaagaccagctgttcattgctatattcattgttaactcctatttcttttacccctttataaaaataaaaactcacaaataaccgaaaacaactcaagaaaatctattagcaaagacactgtttactctgagatgaaattaaagccatgcttactttttttttaattacatttttgacatctaaaaacatttaccttggggagcctcactgattctcctctgcactctttgaccaggaactccgatacatttttgtattgtactggcaattttaaggccttgactttaatgtatgatacataccataaatacttcactcatagagaatacttttagaatacttgtcgcatttctttccaagaatgaaaaaaaagcagtaaatgcttaatttactaggctcactttagaactgatttagggtgaaacaaatccaaaagcctagatgctattcattaactttcatacaaagttaaatatttcaaagtagaaattagaaatacatggtattgaacttgcatgaatcattatatatctcacaagttacaaacatgttatttataaatgtttaatttcatttgaataaaaaatagccactgttacttgcatttttaagtaaacttttaattttgagataattatagatttatatacagttgtaaaaaataatataaagacaatttgtgtactctaccaatttgtcccatggtaacatctggcaaaactagtgtttttttctttttacatcaaaagtgtgatttgtgtacaataaaatatacccacttaaaaatatatagtttgatgagttttggcatatgtgtaccctgtgtaatcaccatccctgtctagagatggaatgtttcactctcccaaacgttctcttatgcttctttgcagtcagtgctgtctctgaacccccaatcccaggaaaccaccaatcttatttctatcaatacagattagttttgcctgttccaaaatttcttagcatagtgttatttggtatgtaatattttcgtacataggcttttaaatcccacctcacccccacttttagatcattccctaattacatgtgctgttagctttactgcaacatggtatctctggcccacttaatcagaaatccattataagtatcaaagtgtatatattaagctcataggtacataatacaagctaggaattggaagcctgggtttatctgtcaactaacatatttgcaaagctataatatatttattacttctttttcttatctagtactttctttacttgatctaagagttcaagtgttgaatagaatctagttttaagaaaagtgttgtcagttgaaacttgaatccttatgagttgtctttttcctttaataactacatttacctttcggggctctggccaagagtgatgcaatgatcagtgtctcagccaagcattggcacttcattggctacttagctattctttcgtcattttgtgacatcattacctgcaagggtagccaagccttcacagagcaatttattagtaaccatgaacacttcttattctttggctctaacttatgacccttttataacattaatcatagatcttatgaattaactacaatcaaactatcagtataaatttttgttagcattataaatagcacagccagcttgaaactttttatataataagccttcctaccactcaataatttgaatggtgccaacatcacactctagaatgcttattatataaatgaatatttctgttatttttgaaagattcctttagagcaccaaagtccaaaagtatgaatcatcatgactaatttgtgtcatatttatattatatatcaggctttaccactgcttattttttctctgtttgttcgcagattttaccctaaatatattttatttatattttaattattgtaatgctagtaaattaattcatttttatataactagcattcacacagttcatattataggatctacatttgatatatgtttagtaagtcaaggtaaagaattttctttcctcactgacatgatgatattattaatctttgaaaaacacttgtactagttctttccgtgagataggtatgtgcataaatgcttttaaaatataagttgaaaacatgaaaaagaggttatgagcatggagataaattaagacagccttacagaagaagcaaatagagatagtgaaagtataaacatagtaaaagaaaagataatatttgaagggataagagtaaagaattatctaaaggtgaggaatgacatgatttttctgaatcccaagtaggctaagaaaagtaaatgcatacataggtataatataatgaatccaataatcaccaaagaccaagcagccagaaagacagaaatctgataatcaccaaagacagaacagcatcctaaaaacagccagagagaaaaatacaaagtgtaagaaattaatttctaagacactactgatatatttctcaacagccacaatgaaagccagaagacagcagagtagtgcctttgaaatgcagagagaaggcaaccaagaaatatggaattgtatttgtagtagtaccatcaattagaaacaagaaagaaagaatgcatttttagtttacagatatatatatcaatattatcaccagcagactctcaataaaagaatttttcgagaatacttttcataaggatatataatgtttccagaaaataggcctggtgtgaaggaaggaattgtgagcaagtaaaccagcaaatatgtggataaatatagaggaaaatttactgcgttaaataaaaataaggttatatgtaagaaagagtataaaaagtagcaggataccattaaatggtcattaaaaatagcatttaaagggaaggggtaaactccaacttcagctccctctagccattctgttgcaccttggggtaagaagagcagttactgagaaatacttgtaaagttcacagccaatgagcacagggctcattaaaaactgaaaactaatcctagaatcatagaacaggggtccccaacccctgggccactggtcagtagtggtctgtggtctattagaaaccggactgcatagtaggacgtgagcagctggtgagctatcattacttcctgagctctgcctcctgtcagatcagcagtgacatgaagttgtcataggagcataaaccccattgtgaactgtacatgtgagggatttaggttgtgcactccttctgagaattcctgatgctttgaggtggaataccttcatcttgaaaccattccccatgtgctgccctcacacccagttcgtggaaaagttgtcttccacaaaaccgatccctggtgccaaaaatattggggaccactgccatagaacgctttccctcccctctcatcttaccaccacaccatgaaaggcctgtttgccagagttccctttactcagtacatcatgtctggatttcaacaaaaagttacaaagcacactaaaacaccaaaaacaaacaaacaaagaaacaaacaaacaacctcacagtttgaagagagagagcaaaaatgagaatgagactcagacatggaaaggatatggaaattatcagaccagaaacttaaagcggctctgatgaatacactaaaggctctaatggaaaaagtagacaacatgcaaaaatagatggcaatataagctgaaagataaaaattctgacaaagaagcaaaaagaaaagctagagatcagaaacactttcatagaaataaagaatgcctttaattggatcattaatatttggggacagctgataaaagaatctgagtttgaagatgtgtcaatagagactaccaaaatagaaaggtaaaaagaaaaatgactgaacaaatagagcagaatatctaagaactgtgagacagctaccaaaaatgtaaatacatataatggggaagaagaagaagaagagaaaggaacagaagaaatatttggaacaataatgactaagaatttttcatattccaaatgcagaaaaatcaaagttagggaaaaatatcttaaaaggagcctggctgaagggggaacatctagcctatgaaaaagcaaagataagaattacattctacttctcctcagaaagcatgcaagcaagaaaagtggttaaatagttaggtgttgacagaaaaaaaaaaatccacctagaattctgtatcttgcaaaattatcctttaaaagtaaaggaaaaatactttctcaaacaaaaaccagtagacttttcttgccttgcaagaatgttaaaggaagaacttcagagagagagaaaaaatgatacaggtcagaaaactcagatttatgtaaagaaagggagaacattagagaaagaataaataaaataacttttatttttcttatccttaattgatctagtagataccagtttgttcaaaattataataagaacaatgtatttcattattatagcatgtgtgtaagtgaaatgaatgatagcaacaatacaagacaccagagggaggaactaggaatactttattattattaggtactcatgccaccttttaagtggtatcgtgttatttaaaagtcaacttggaactctcgcatgacattattttgtcttgatagttcaagctccacctgcggttctcccgtcctccatgccaggtgtcaggggctgctctggatgttaactcttccgccccatgacttccagttccaaaatggcggcacagaaacaagctgccatgccacaaccccaccgcgcccctctcccgccaaaaagaaaaattaacaaatatacattgctgagattatcaccagaaattgtcacgatagtccagaactcaaatatgaagatataactgttcccagggccataaggaaatgagaaacaccaagtggatggtaagaaacctgactttcacatttgtagcactcgttaccccattttgcctgacaccaaatatgcagaagattttcctccaactcacttttttctacactggaaaaattaagattgaggtaaacaaccagcttccccagccattctgggttaccggaaagagacctgtcctatccatgcctcaacccactggaagcgtcatgagtgcctaaagggagacatattcctgaagataggcagagacaaagggggatgtaggtctgtcatccccagcctgggaaagtctgctctgtaacttgaccaatgcagacacaatgtcagagtagctgcttagcagcactatgatgcaggaggattatttcactgttctcctcggcacaaacccttaggcagccttcccatactgtcaggatattccctttgggacctctcttgttaagaagggcacaattggattgtttactgaagccaaggcgaacctgggcttaaagcgccccctatagctccctagaggaagcaatttagcagcaaagacatagatgtatgtccacaagaaaaacagcagtaggaaactatgatgtctccaaacagacaaagcagggaaccagggactggccctaacaagacagtaatatgtaagctccctgaccacgaattttaaaatgcagttttaagaaaactcagtgatctccagtagaacacagaaaaataattcagaaattcattagagaaatttaacagagattgaaattttaaaaaatctatcagaaaccttggaactgagaaataaatttaccgaactgaaaaattcactagtagctctcaccatcagaatggattgagcagaggaaagaatcagtgagcttgaagacagaatatttgaaaatatatggtcgaggagaaaaaaagaacacaaagaaatgaagatttcctacaatatatagaaaattattaatacctcaaaaggccaaatgtaagaattaatggtattcaagagggagttgaagaggaaggattagaaatcttattcaacaaaataataacaaaaaattccaaaatttaaaagtatacttggattagttataaatgtatattataagctttatagggcaacccccaaaaaagttttaaaaaggtatagttgatatatttaatacttacaaaggaaagaaaatggaaccatgtaaaaatgctcaactaaaaccacaaaaggtaaaaagtatatagaaaacaagaatagaaacaaagaacaagggcaatgaataaaaagtagtagatattaatccaactatgccagtaactactttgagtgtcaatggtctaaatataccaattaaaagagagagattgttagaatgaattgaagaataaaaccagctcattttataatgccaacattaccctgtaccaacatcagacaaagaaattacaagaaaagaaaaccacagaccaataactctcataaaaatagatgcaaaaattctcaacaaaatattcaaaataaaactattaagcaatgtgtaaaaataattatatatcagaaccaagagggatttatctcaggtttgcaagactggttcagcattcaaaaatcagctaaagtaattcctcacatcaacaggctaaaggggaaaaattacaagattatatcaataaatgtagaaaaagtatttgacaaaatcaagcatccattcatgatcaaaactctccacaaataaggagtagaggagaacatactcaacttaatagaaaatatgtataaaaacctagagtgaacatcatacttaaggataagaaaccagaatctttcctactaagatcaggaataagacaagaatgtttcctctcagcactccttttcaacaacgtattaggaaggaataaaaacaacaacctcatttcaaaataaggcagtaaaggagaacgaaagaaaaaggatatatagaaaatagaaattccaaataaataaacaatcacaacaaatctaaatgtgctgaacatattagaattatgagactgtctggctgaaagagaaaacaacatccacctattgtctgagcagaggctgaattagggcaagagaatgtcttaatcacaaactttacaaaagcaccaaaaacaccctattaagcaagatctataatatttttatgttatatttcaaaaagtcaaatgatttagaaatgtataattaaaaatcaaaattttaagtaaagacacattagtgttgcttgttttatggtcctgtgttattttgtaatgggagctgttgtttctaatcagtccataattcctacctaccagttttataaggttggcatgtacctgtctcatagaaggttttacaatcgtctagaaacagactaggcatgatgggacattatacacagctatttttttaaaactgtagagtgtttattaactttttccatttggctccaaagattggtaaatattttctagttgtatacagaggttcgtatttttcctttgccctcatgctgcaatgcagctcagcatggtacttgtgctgagggtgtgagagacatactcaaaaaacaagcacacttcaagtttgaaaatttaagaaagctagcatgagctacataaatattaggcaaaacagacattactgtttcattaaagaaaaagaggcttattgtataattataaagtataaaattctaagtttacatgcatctcataatatagtttcaaaagtataaagcagaattttatagaaccagaaagagaaattggcaagttctaccatcagcatagaagaatttaatacatctcttattaaaaatgtctttttataaaaagaaagaaaagctacatactagcagttgtcattagcaagacaacacatatataactgacaaaggtaacatttaaattaagcaaactatttgaaaaacagacaaaagaagtgaacaagtaattcacagaagaagccagaagtggcaactgaaatggtcaatatacatgtaaagacatgtgcaactttactggttatcagtaaactaaaaaaaaagaatgtgataatattttatactcatcaagttgtcaaagatggcaaaatctggaaatttcaggaactggtaagtggggactcatacaccacttatgggaaggtgctgctgcactatggaaaacaatttgcaaatgtctacgtggaacactttacagtagtggatatgaaggaatatagctatcacatcaacatgaccagacttctcaaacaatcatactacagaaagcttgttttagaataatacatacactgtatacacttatataaattttaaaatcatacaaatagaaagaagaaactgataaaaggataggaggcaggactaacttgcagctccccctcggacagacagagcagcatgtgaagacacacatcatgaacttttctccaagaactactgcagcaacataccaggaaagccacgagaatccacagatcctttgaaggaaatagattgctgctgcaggctccaggagacagccgaaaaactgtaagtgcccaaagtgtgaaagggggatcttccacccctgaacacatagccttcctggggaacctgaaggtccaggtcacaggtgatggatttggccttacctggagctgagacaaacttagagagctgaacaaaatataagggtaaaggaagcagggggaagagccctgtggactctctcagcccccaggaaaaccatttctgactttgtctcctagggtccttgggtaggactgccagtggaagtggggaaagaccacaaggagaaggaaacttccagatgaactctgtaacaatttcgactgaatgccaactttcctagcagaatctgggggtgagggtgaactgggagtgcagacacagcacagaagttgcatcaggcagggaggtgtgaaacctgaaacccctgcttgcttttccagtggggagacctggagcaggggcaagtcctcagccctgttcacccattgcctggaaataaactcagtgctgttgtggagagtattgtgggagtgagactggccttttgggttgcatgggagctgggtgaggcctttcactgccagctttcccctactttcctggtgacctgtatgatgtagcagaggcagccataatccccctagaaacataactccatcgccctgagaaccacacccccaacactcagagcagcttcagcaaggcctgcccaaggagagtctaagctcagacacacctaaccctgaccctacctgatggcctttctctacctgccctcgtagccagacaaaggacataatctcttgagagctctatggccctgaccaccgcctgagaaacttatccaggagactctagagcaagcttgtatcctccctatgctactgccgttgatgctctcttgaaagcgccacctcctgtctgaaggccaaccaacacaaaactagtgcaataaacaaaaatacaacaaaggaccctcacagagtctacttcactcccctgctatctccaccagagcaggtgctggtatccagggctaagagacctgaagactgatcatatcacagggctgtttgcagttactccccactaccagtctggaggctgctagctccactgggtggctagatccagaagagaaacaacaatcactgcagttcagctctcaggaaggcacatcctggagcacccacatccagggagcacccacatctagggaacacccacatctggggagcaccctgtgggaagaaagaatctgaacaacagcacttgagccccagatcttccctctgacatagtctaaccaaatgaaaagcaacctgaaaaacagttctagtaatatgacaaaacaaggttctttattatccccaaaagatcacaatagcttaccagcaatggatctaaaccaagaagaaaactctgaattcccagaaaaagaactcagaaggttgattattaagtgactgaaggaggcaccaaaggtgaatatgaactcaaaggaatttcaaaaatgttacaggatatgaacagaaaaatctccagataaataaatagcataaataagaagcaatcataatttctggaaattaaggacacacttagaaaaatgcaaaatacactggaaagtcttagcaatagaatccaacaagtagaaggaagaacaccagagcttgaagacaaggcttttgaattaacccaatcaaacaaagacaaagaaaaaaaaaaattaaatgaacaaggcctccaagaagtttgggattatgttaaacgaccaaatctaagaataattggtgttcccaaggaagaagagaaatctaaacgtttggaaaatctatttgagggaataatcaaggaaaacgtccccaaccttgctagagatctagatatccaaatacaagaagctgaaagaacacctgggaaattcatcacaaaaaggtcattgccaaggcacatagtcatcaagttatctaaagtcaagatgaaggaaggaatcttaagagctgtgaggcaaaagcatcaggtaacctatgaaggaaaacctgtcagattaacagcagatttctcagcagaaaccctgcaagctagaaggaattggtgtcctatccttatcctccttaaacaaaacagttattggccaggaattttgtatccagtgaaattaagcttcctaaatgaaggaaaaatacagtctttttccgacaaacaaatgtttagagaacttatcaccaccaagctagcactacaagaactgctaaaagcagctctaaattttgaaacaaatccttgaaatacaccagaatacaacctccttaaagcataaatctcacaggacctataaaaaaaaaacacaatttaaaaaaaagcattcaggcaacaaatagcatgatgaatagaaaggcatctcacatcctaacactaacattgaatgtaaatggcctaaatgcaccacttaaaagatacagaatggcagaaaggataagaactcaccaagcaagtatctgctgtcctcaagagactcatctaacacataaggactcacataaacttaaggtaaagaggtggaaaaagatattccacgaaaatggacaccaaaagcaaacagcagtagctattcttatatcagacaaaacaaacttcaaagcaacagcagttaacaaagagggacattatataatgataaaaggactagtccaacagggaaacatcacaattctaaatatatatgcacctaactccagagctcccagatttagaaaacaattactactaaacctaagaaatgagataaacagcaacacaataatggtgggggacttcagtactccactgacagcactagacagatcatcaagacagaaagtcaacaaagaaacagtggacttaaactatgacttagaacaaatgtacttaacagatatttacagaacattctacccaacaactgcagaatatacattattcatcagcaggtgaaacatcctccaagatacaccatgtgataggccacaaaacaagtctcaatacatttaagaaaactgaaattatatcaagtactctctcagaccaccgtgaaataaaattggaaatcgactcaaaaaggaaccctcaaaaccatgcaaatacatagaaattaaataacctgcttctcaatgattcttgggtcaacaatgaaatcaagatggaaattaaaaaagtcctttaactgaattgtttgatatagtgacacaacctatcaaaacctccatgatacagcaaaggtggtgctaacaggaaagttcatagcattaaatgcctatatcaaaaagtctgaaagagcacaaatagacaatctaaggtcacacctcaaggaactagagaaacaaaaaccaaacccactcttattgacttaataaggaaattaaaaaaagtatgctgagattgctaagatctattataataatgaatcttctatctgtgaaatagtgaaaaaaaaagaaattagtgctagatttgctgtcaaaccacaaagtgcaaaagttacggccgcagtgctagataagtgcctagttcagattgaaaaagcattaaatttgtgactggaagacatgaacagaaaatatgtactatatggaaccaaaatatgtactacatagtacacatagtaccaaacccagttgctgtcacttggcacatagagatctggcatctactggaggtcttcaaatgtattccttgtggaaaacaggactacttactatactactaaattcagatattattagcggagtggaatatatatggcagtatcttgtttctaagttgagtggtacataaaatggtacaattctttttttaattattcataaatttatttttaatatttcagtataatttcccttaaacacaataatatgattgattaatctatcaggaatgtatcacctatgtaaatactcatgctactactaaagacagagtggaggtgactctattcacaatggaataaccattactaaattcatgattactgtgtacatttatagttttactgtaaagattgatcatttgctagctttagtcactcaacaaatatttataaatgccttctatgtgtagtgcattatgctagagtacagccattatgtcttgattacagatgcaagtatttgaaaatattgaaggaccttcatttgtgaaattcaaaaaagattccctggcagacaccaattactataataaatagagatgacttcagtgcaaacaaatgattcaggctaacaattagtaattaacaaataatataaatagtatagacattttaaatcttaaagaaaaatttaaatgcagcaatacttaagaaagggttttttaatttactaatgtagtaatcaagtctaatactacaaaaaatttctaatatgaaataccctttatatttaaataatcaaataccttgtataccagttgactaagtttagaggaatcttaaatattaaaaaacatcaataacgccttatacttcttagtatgtgaattcgtatttgtatgatgtatattattttggagagttgcctgtaagcaccatattaatataatgaatgaagcttttcttcattgaagtcctttgtaaaataatgcaggttatcctgaataaatatggtctctattccaggccatatttcctggaatatcaatagggttaaattattatggttgcaataaaatagaattgctttatcttgtccactatctacaatcttgaataaactttaaaatcctccttctgttctcttaagggaacgtggtgtgtccccatgtgtcttttttatttagtgccctgaacaatccataaataagaggaagaaggaataaagaaggacagagatttcaaaggagaaatcaaatacctaacaacatgcagtattgaaaattaacaaataagaatgcaaggcctctcatgcaaatggttccatctcattcaaccactagacataattacttctgtattcacaaggcctacagtaaggaaatactgtttaaaaaaataggctatcaattatatttatatatagacaacatgtagactgaaggattatccgaataatcctgcctagagtttctgtttttctaaatataggttttatgtcacgtattacaatttgtttcattggataattttccaatcttccatttcactttacccatagaattagactaggcattacttgaattagaatgtttctaaaaatagccacttatattaatagttgaaatattgaagtaactatgtatgatgtgtttgtcgtcattgtattgtcacctatgtttgatcagtattgtccaacagtattagtagttatttattttatgctattaatttcagtatctagagagtgagtaagtacattgtatctgtgaacactttaattatgtaagaatttctagccaagggaaagataattactgaaaaagggatatgtcattgaaggataaacacgtggcatttctgtcttctcagtggtaaagaatagtatttgttttggcttttccaattgaaattacataatctgtaggtaaaaattcacaggtgaagtattattgcatttgcctttaaacctttaatgttactattcaattaaatgctagtcacattaaagtacagtcctgtaatgtgtcataaatgcaatgagtctgttaggacattcactcacacattcaccaaatatatatgatcacctcccatgtgcaaagcacagagccattttctgtctagattctctatgtagttgggcactttatctgtgttcccctctgaaatctatcactgataataaattaacaagtttgtctaacattacctttgccatgggaacattagagctacctagggacacttccattggaaaaaagatacctgagtacactaaagtttttatgtttataaagatgatttctctacctagtagacaaatcacagtgaaactggatcctttgaattaccatggaattgctccagccagaggaaaggggaagccttgaatagagccggaggacaattactattattagagatttaggctcttaacatttccaacatagggggctggtttctactgatgagaaagggaaaatgtacagattttcagagggtctgcaattcattcaggccatctgggaatagttaaaaaaattacctcttttattcagtgagcagtactgtaacagtactaaaaagtgatcattttataatctttcactttgaagcagattgtctttctctccttctcacataggcagtgctgcatccatatctctaaattttatagccaggagtggaataactacatcttttggtttctagggctttgctgtccagtttagactcagcagaaagtaaagatggactgagccagagtgactccagtcaacacctctctccctcgaatactattttcggtccctgaagccagtataaacatggagattagaagtgaggtctttgaaggaaaacatccagatatataaattgagtacctactatgttctagggctccttctaggcacttcttcaacatattgaagacaagttgttttcgatgactcattgtgatcattatgaacttaagcttccaaaggtcattgacactgggagctctcaggaccttgaagggaaattttctccctagcccccagccttttgcaaggacttcatatatctttgtctaagaggatatttttcttccttcttttttcaaagatacatagtaggcatttaagattgttgtataagtgactgaataaataaattgctcttgcagttaaattacttaaacttgtattttacacaagtttctactttctctgtaaatttgaaggtgttaagaaataagtaaaattgagtgtgtggcttgtcatggtggctcccgcctgtaatcccagaactttggtaggccgaggtgggcggatcacttgaagtcaggagtttgagacgagcctgggcaacaaggtgaaaccctgtctctaccaaaaaatacaaaaattagctgggcatggtgatgtgtgcctgtagtaccagatactcgggaggctgaggcatgagaatctcttgaacgtgggtggtggaggtttcagtgagcccagatagtgcctgggctccaacctgggcaacagagcaagactctgtcctttatctccaaaaaaaaaaaaaaaaaaacattgagtctatcaggagtggagttgataaaaatgctttggagactatgggttatctttgaaagattgtctttgctgctctgtaatggtaacgaagaaacactatacttcagtttaatgatccataagaaataactgtcattgtgtattattagaatataatgtaataaaataaatttcatcagtgtcttctagattcaatgactattcaatgattttcatacctgaacatgtcaaagtatttggctgcaacttagcggagttgattagtagcctttaagaagctatcaaaatgaaagcagttaaatgaatcagtggtaaaggtccttgaccctgatatagccattgtctaatctcataatttgggcattcagggacatatcgggggaatccagttgttacagaagaaaccgaaacataattgaaagtgacaaatgatcaactggagattgggaaaacatgaaatagaaaaccatttgcttcaggagctgcctaaaatataagatacacacagagttcttgattttaaatcaaactttaaaatcactggtagaaaaggcagttgaaaattatgagaattcaaaaatttacttataatgcacttaccaattattatttcttccattttgtcatggttatccttgtattatctgaaacgagttgttaagaaccaattatgggaccaagaatttaatacttcatgaaactttataatcaaagaatagactacaaagtattccttctgtctttgcaaaccatacaaaatgataatagaacagtatcatctttaggatcaaagacccaaataggcattggtgtgtcatttagttgcatatgtcttaaatcaaattttaaaacaaatttaggcatcatctctcaaaatctttgcttctgtatattaatcccattgttttggaaaaaatgtatattttttacaaatcatactctgtttactggtggctcaaaaactttttagcttacatagtagttgaaaagagaatcattttttctgcagatttttgctcatctgtgtgtaatttaaaactgaaacatattaattttcttaggttttcttagtgaaatgttacatgcaaatgatgtataattatcttgtaactatccatgcagttacattttatttgctctcaatttttaatacattagtaataaatgtacactgtggaaaaaataaagttataaactttatctgtaaacctaccacccaccggtaaccccagccaataatcttagtttatatactttcaggcattatattattgttattattagtaaacctgtctcatctgtctctatcttcttaaaattgcatatttatatctatagataagtccacctttatctagaatagaggattatactctgtatattatttttaacttgattttcaattcaagctgtattatgaatatatttctctatttatatttataaatgttagcctttttttttttaggaattggaacatcttaaaccactctcttgcttttgggcatttaatttgtttccttctcttcagtattatcaacaccccattattaaaacagaaaatctttatcaagcagctttaaaaacatattctcggacaggcacggtggctcacgcctgtaaacctagcactttgggaggccgaggcgggtggatcacgaggtcaggagatggagaccatcctggctaacatggtgaaaccccgtctctactaaaaatacaaaacaaattagccgggcgtggtggcaggtgcctgtagttccagctactcgggaggttgaggcaggagaatggtgtgaacctgggaggtggagcttgcagtgagccaagattgcgccactgcactccagcctgggcgacagagtgagactccgtctcaaaaaaaaaaaaaaagtattctcctaaattctcagtggaatttctgggtcctgtggaatgtatacatatgttgctcctcctaaaaggagtggataaactcctctcctacaagcagtgttctgcactggccctttctacaaattcctttcaccctggtattatcataatctaaaaaataataatttgagaatcaaaaaataacagctatgcttgttttcttcaggaaaacagaacaggttatccatatatctgcagggtttttttctccacaaaagaaaggccagccattttcaataacaagtagtttggcaggaccagaaccattccattgggtcactggtaaaatttgtctttggctttaaacattaaggcagccaggactgtgtctttggacattgatacagcatttagtccagtcttatttacaattaggctttttgataatggcttttgggctgacgttaagtataaaatctgaaattagattttttaaagattataatcaaaaagcaaaaatgtcttcctagaaatagcaaaggaatgcttttgctggatttgctccactaactcatgtaggcaatataccaaactcaaacagccagcagttgttttgtaaaagacaaactgcatctgaaatcagtatgacaggaccacagtttccatctcatcacttccaccaacttacatttaagaaagcacaacttgaataataaaaaccaccatagagtaaacaaattcttcaatgagaatgctttgaagtcaagagaaaaataggctcagggcattgtgttacagcaaaattttgcctttggcaaaagttttacgatggaatagggtttttaaaatattgggaatcaggtaaattgcatggctaattgaactggggaagacagcttaatgagctcatttctctccttcaaatccaagaagtcagaaggcaagttttcatctattctttcatttatccaattagaacatatcgtccccacacatagggctactagaagaagtaatagttatgtctgatggctcttaggaagtattgtcaatagataggacctcctctgtagttataactacagatgatcaaattaaccagaaataaattttggtcataaatttcttcttgctccactctgtaggctacctcctccaaagcagatcgtagaccagtgcatttataaatcacagaatcaccttttaatggttatagactatatatagcatagtgacagtcatatactgctggtgctggtcaaacttgagatcaacaattctgttggatttttacccctctcttccttctttttcctcctcttccatattctgactttcaggtttgagcatgtaataacttccaggatttgttttgggcattatttatatattaccacttatcctaagattattttgagtcagataaaagtaagacattctattaagttatcttcattttgaagatgaagaaactaagattcatagaagtaaagaggactctaggagtaactaactgtccattgtcattgttaatgttacttaacctctttaatcctctgtcgtgaatccaataacgatcaaagtagtaggcaagtttgctgagggccaactgtgtgacaagcactttgataactgattggtctttacagcaaccttatgagagaagtattattactctcatattatgagtgagaaaaataaggattaaagaggtacaggcaattactcaagaacacagggctagcaaatcaagaaacagaagttagatgtgagatattgtatcacccaggcctaaaagatgcaatgaaacaacccattttaaatgtttaatatagtaaccagagtatactctcatttgatgagagtatactcatcaaatgagagtatgcatttgatgttacttttcacagtggcctttttgcagttaggaaacagcagcaccaataatagaactaagctgtctgactcccagcctgtacctaaatctctaacttttgattttatgaaataaatttgatttgcagatgggcattgctggtgagggaaatgtaaagaggtcaatttccccactttaaatttttttggctaaagacccatagctgacaatattttaatggttgccacatattcttcttttatgaagtgagtttcattttatatttgtaagtggtttttattgcaaatcatcacctaacagtcaattctgaagactttccataaatgtcaccttgtttgtgaattgttctcattctgtctcctctctaaattccctcaagaacaactttctttggacattaatatcattattaattgtgaattgtcagctaacagcttagcaattgtctatcatgctcctaatgcatggatgatacagagaatataaagtcaataacttgtatttcctgaaagatacatatacagaagccaatcatttcagtagagtgacaggagcaagattgaggtattaatagagtactctgagagatgagaagcgggacaactaccttagcctaaaggtttgcaaatgattgtggggaaaaataatctttatcactccaaaaagaatattacagtgatattttaattgaccatagagtttaacttgaccattgtaaaatgaccaaaagggtgaattattttttaccaattattaaaaagtagcactacctgatataaacagtgtgacctaatgtttacattcttattattttttctcctttttgtctttttctctctccccagctaagtagaaaaaactcactttgttttcatgctaaaattttggaataccattaaacagcaacacactggacaactacattcttatgttttatcttctccctttaagattgttaaaggaagaaattgaactagtggggaaaagtaaatactggccaaaaaaaaatgcttttgactagtgtatgttccaatgatgattatgaaatatgtcaaactgttctaaaatactaaatatgtgttactatttattctgtattaaaatagaacaatagaataacctttgttgtcccaatatgaaaatagtttttaacaatgttaatataaaacaaagagcaaaggaccattatcttggataaacagagagacattactttacatggtttgactcccctgattcataatttaacatgtaactctggcatatgctgggcacttagggaagtcacattaagtatttcacagcaaatggagagtgagaaaaatgattttcagaaatcctggtatttacttattataaatcttgtcttgaatttattgtactttacatgaaatataatttgataaaatgtaattggtttcagtgtgtatgcaaaatgagaattttctgatcattcagatatcaaaattaactttataaatacaaatacatataattacctattaaaattctaaggtgtatttattttaataaaagtctttatcaaacctagataaatctcatttatgattataaatgtaaaactcctaaatttttttttacttggctttatttactattaatgatgttgggtttattaaaaaatgcaagcacagactccaattagcctactaacctattgtataatttatcaattcaataggtcaaacaattaaatcagaacatttaataaaattgacaatatttttttatttttttacaaaaatccatattggttgttttgaagtagcaatttcttcttcaaaatgataaaaattgtctatgtaaaatcaatagtcaatactataaaagctgcaacattatagacattttcattaaaatgagtaaaaagataattatgcctatcacactactataccatataaattaactattatgctgaaaattctggccaataaagtaggggaaggaaataaatataactgtatatttaaaattatgaactaaatcttcactgttttacaggcaaaggaaaattctaatatctgataaaatctttaaagtcaattaaaaaagagtatactaaagaaaaatgaataattttctcaaaaaggactatatctaaccaagaactaggtgaagattggcattactagtatccaaagacataaatactaaaacagtaattgacatattatctaaaatcaaaatagtgaagatataacaattatgggcagaacacaagaaaatggacattctcagatattgctggtgtgagtatgagtttaatttttctagaaggaatttgaccatatttaacaaaatctttaaaatgtttatactctttgataatgtaatttcatctcataattttcttaaggtaatacttagatatatatccactcccgatccccaaaataaaatggaaaaaaaaaaactaaatgtgtaatgattgcagaagggttgaatgttattttatgagaaatataagaaataatgcagcaaaatacatgatgtttaattatacaaaactatgtagtaatacaaaatatatgatttttaataacacaatacccatgtatattcataattttgaaaagaagaaatatatgcatatacaaatttgaaagaaattatctcatgttgacattttgacttatcatttgctagtcaaattaccagtgcttttaattttctacctcctgcctttgttttataaagaatatttttattatgtctatagttatactaaactcagttcagttgaattgttatttaaatctatggaaaaaattttgctttgtccataaattgtatttatattagaaagttaaaataattaattataaaacatatatccaggtttttttatttgttccagtacataacagacctattacataatttgagtaaattttgtcttacagttatacaggcagttctctccttacacaattctgatatgcatgaatatcagttatcatagtttagttaaatgctaacagtcctccaacaacgtaactcaagtgttgggtaacattgaatattactgtgagtaattacataaacaaacattgctgctggctctgcagtccacaaattaccacataaaataacagatgcacattgtgatcagtgaccgatcacgtttatttttttcagtatctgttggtgattgcgcactacacatttatcattcagtttatttatagaagagaagcgtgtggttgtgttgcctccttgtgagtgataaacccgagtgacactttacaaacacagatattcaaaaaagaagaggaattggacagcaaagaggaaagcactgcaaagaaagaaaatacttgaagtaaaattcagattgaacctaagtggagtcatagaagaaatagtcactactgaggtttgagagattctgaatacgtagccagagctacttagtgaaggtgaacttaacataagtgagggaagtgcttgccacaaatagggtgaagatgtcctggaggaagtgacacccaaacacttcacattagaggaattctcacaggtacttcacaacactaaaagcataaaagttaaaatgttggaagctgattcaaacttagaaaggagcgtgacaattcaccaaggcatagaaaagaagtggccgggtgcggtggctcacgcctgtaatcccagcactttgggcggccgaggtgggcagaacacgaggtcaggagatcgagaccatgctggctaacagggtgaaaccccgtctctactaaaaatacaaaaaattagccaagcgtggtggcgggcgcctgtagtctcagctacttgggaggctgaggcgggagaatcgcttgaacccgtgaggcggagcttgcagtgggcagagatcatgccactgcactccagcctggggaacagagtgagactccatctcaaaaaaaaaaaaaaaaaaaaagatgcttgtgttcagtgtgataagttataggtgagatgaaggcaagcactgttcaaagtacttttagtgagtattttacaaaggactaaaacaacttctccaagtttttaatgttttaaattacagagtactaaataaatggtcatttttactggtttatttctttacatttataaccagcattggagagttgttaacatgttgaagttttacaaagtcttagagctatcataacctttcctgttgattattaagatcactttgcatgtttgtaacacaaaggttaaacacttgaggggatagatgtcgcattttccaagatgtgatgattacacgttgtatctctttttcaaaacatcccatgtagcctataaatacatacacctactacgtacccacaaaaattaaaaattaagaaaaaaaaagatcattttccatggttcaagtttgcatggtcacttttacaattccaccctaccatgcccgtaaatatgctatttctgacttacgaaatatttttcaaataaaatcattgctgacttttaactcactgatatgtgctttacttctggtgaaaggcctaacatatcaataaaatgaaagaaaatcacagctttattttctttactgttctgatattttttgttctagtgtgatcgctgcttgcctctttataatgacaagcctttccgccaaggtgatcaagtttacgctttcaattgtaaaccttgtcaatgcaacagccattccaaaagctgccattacaacatctctgtagacccatttccttttgagcacttcagagggggaggaggagtttgtgatgattgtgagcataacactacaggtaagtagcaaataaattcctgagttggtttggaggcctgtgtgcttctatctacaatgcatattattttaaattatgttattgctatcttatttaaggatgtactttcatacctttaagtttgaaaatcaaagctagttcaccaaatcttcctatttccaaatcactaggtagttttcagaaatagcactctagtcttaaactatatcttttcaggaaaaggattttgttgttgttgttttgttttgttttgttttttaaagagttcacaccatttgactaaaccacaaccatatttagaataactcgggaatgcttactttgaacacatatccttaaagtaagtttccttttgtcccctttattgtcctttatgtctggattctcatgtggagatggcattcattcagatttggcatggacactggtagtctgagaatactctttttgaaaatactaattaaatggagacgatgataatcaaagtcctgttctaaaactacaaagcctttgactagtcattgaaaaataccatccttattttgaaaggcaagaaatggccaacatctgaatttgtgaaatataatagcatatatctgatgggtttcaaagtggtactcttaagcatgaatccatttatcggctgattattgataacttaaatatcacaagatcttgggtaggtgctggggacatgaagatgaataagacaatgaattttctgtctttgggttattgtacagtgggaaagacagactattgaaaggaatgattacaaagttgtctgatgattgctaagatagggcaaggacagtaggagttaaccagttgaaagattaggatggtgaactaaggcttacaattagggaaacattttgtgcagtggcctagaggagggagaaaaatgacacgtttgaaaaaccataagatgggcaaatggctggtggtaagagatattaggaaggaaggcaggacaatatcatagaggactctggagccatgataaagcctttggcttttatctaaggtcaaggagatgacacttaagggttttatatgggaaaggggcataatgagttacttgttattaaaagatacacctggttataaagtaaaaaatggattggagaaggttagagtggttggggaaaactagttagtgaggtgctgcaatagtccaggtgagaaataatgtcagaatacatttcagatggtacggatagagagaaatggatccaagagatatttaggataaaaaagtgagtgttttgtgagcagagtgtaggcaagggaaggaaggagagccaagactgatacctaacattacattctagcttgagcagtaggctcaacattggtgccagccattgagatagaaaatacaggaggattgagatgagggaggagatggcaagttctgttgtggatatgttcactcggtttctaagagacataggagaaactcctgggggcagttggaaacacagttctgaagctctttccttcaaggaaatcctctcatgatgctttagagaagatcagaatcacttacacatgttagtgacaactatgcttatcatggtttataaatgtgtattactcctggtattatttagttcagattcctcttacctcctagactgtaagagagctttgtgaaagagatgcaatgggtattgtgtatttagtttactactgtattacacagcacttagcacagtatttggtacatagtaatcacgcgataaatattcattaattcataaataaaagagagatttctggattggagatatggatttgggagtcaacagcatatgtaaatggaaatagtctagaaatattataaatcaatttaatttttaactagctcaatagccaatatctatcagaatatgagttttcatattattgattattgattatttctgtagtcttcaaatattggagaaatttcaatattttttgagcaaagtacatcatgtttaaagggggaattgatagtcttgagttctacttcagcttatttcaattatcttatacactagtcacgttcactttaaaaattccttgtagtttaggttttttattacataatatagcaaaggaaatttgtaattataaattataaactatgggaattacctgatatatctaatatgtcaggctattctagtatttagtatgaaaagtacttggtatctctaaatataatgaatttctatttcaatctttgaaatgaaaaataatggccactaacataatcatttgtttttaattgtgttaactacagaataataaattatattaagagaagtctcccattttacatgattgagttctagaaaaatatttccaatactacatacctgcttgcttcttactgtataagtatcatctaccacatatgtagaaatttctcctgctgtattgagtttagataaagtgcctggccccagatataaagttttaagtttaggagcaaactctttccaaatgtatgggcccctataaagcacagctttttagaagtgtggtattatataacagatgggagtttaatgaagtaaagcacagtttgtaacaggttcattgtttcatatgctctggatcactaaattggcaggtagagatgaaaggtgcattaaaacggacgttccgaaaattatagaattccctcaaaggaatacagtctttaattttgaattatgcagctgattttaatgaattagaagtcataatgcataacctttccctgatgcaggaaggaactgtgagctgtgcaaggattactttttccgacaagttggtgcagatccttcggccatagatgtttgcaaaccctgtgactgtgatacagttggcactagaaatggtagcattctttgtgatcaggtgagtttttctgagtatttaaggtaaaggattactctgtctgccagaaacttatttggatgttattccactagtagaattgaagactgcatttgccaggaaatcctctatgtgcatttgcatttcaaagagatggttgttcgtgtgcaactttgagtatggacatgaaatatagcactagttcggtggtcctttgcatataaaaaggcttattttagttttaattttacaaatgtcaaaaaatcgaagggtaggggttctaagtaaattggggtatatgtcttggaattattggtgaattaatattaatacatgatataaataaacaagaatagtttctccaaaaattccatagaagatcatatagcaaaagtcacttacacttagggccaaatggaaattatgatagcctcgcttctcaatttcttagtctaactttccctcttaaaagtacaatggattttttataattttaaaactttctgtttacttacatcacaaatatcgatgtctagcctacatgcacacagattctaactaacctcagttcatgtatcctacctcaagcaggaaaacaggcttcttattgaagctgaagtttttcctgttctgataatactaataagtgaaaattgtgaaaatcggtaaaggagaaatttactttgaagaatcaattcaatgattgtattaattttaaacagttatatactctgttatgaataaataaggctaggagcataaaccacaatccagttatagaatatttgttaaaaagttatattgtgaacataatacacacaagacaaaatatctttctcctataattttgagaattcattaaaaattgctttcccaaataaaagacaaatataaaccaagacaaaatatggattcaaagaccttcagagtaaccatcatgtgtcaataagggggcattacatgcttcattagaaagctgaagagtagaaaaattattaataaagacaatttctactatttttattttataatattgagggactattttctcagaaagtcatactacagttttccatatattaattagtaaactctgactgtatctttagattatatttcatttttacacatccaccctgagttttcagcatggctatcttttgcttatcattcaaatattgatatatcatattttgagatatctttgctgaccacccaattacaaaacattctcaagtctttcatatcaccatgttactctcattacaggctctgtaaaattaatttatttgtttacttttcttcttctctctttccaacataaacagaacagtttcgatcatataaaaagcccccaataagtatttgtcacataaatgttgaatgaataaagagagattatctgagcactgatcttatagttagattgttattttaaacggtcattacaataatctgagcattatgtaaattttcacttgcagaacagtttttctccctgaaaatctaaggtcaagagctttgttatatagtataggaagactgtaaactatagttttacctcccagaatctcagttacgtgtctaacctacacgagttacagtgcatcagatttgtctctccatttcaccattcagatctacaagaaattgaaacctgatttttctgaactcaaacttctatttcaagtccgttttatagggatgctagacaaccttgggtggttctgtgcttgtaaataattaacaactgactaagaaaaaaaaaaggccaccataatcaatttcaatctaccagtgagatgtcactgaacatggatttcagaagaaatgtacttaatctgctcttatgagccagtgcagtgtactccagcatactactggctctagatttctttcttaacatcttataaagtggagctaattattggatggaattatgaaagactgtaccatttataagcaggatattagctgtagatagtgttattttttaagttggagaaatttttctctattcctagtttttctgagagtggtttttatgaatggtgttgaattttgtcagctgctatttctgcatcaattattatgatcatgtgatctttttttctttagtttgttagtgaagtagaatacattggttgcctttcaaatgttgaaccagcattgcatccctggaataaaaccacctttgtgtgtgtctttgtgtgtaattcttttcatatattgttaaattttatttgctaaaattttgctaaggattttacatctgtattcataagaaatattgctctatggttttgtttttataaattgtgtttgtttcattttgttattaggataatactctcgtaaaatgaattataaaatcttccttcctgttgtttttctataagaaatgcagaactggtgttaattactctttaaagtttaccccattctaatacatagtattctagtaaatacagtaccccatgtattagtccatttttgtactgctgggaagaaatacccaagacagagtaagttgtaaagaaaaataggtttttatttatttatttatttatttatttagagacagagtctcgctctgtcacccaggctggagtgcagtggctcaatcttggctcactgccacctccacctctggggttcaagctattctcctgcctcggcctcctgaacagctaggattgcagatgctcaccaccatgcctggctaatttttttcttttttttgtatttttagtagagacagagtttcaccatgttggctagactggtgtcaaatcccacccacctcagcctcccaaagtgctaggattacaggcatgagccaccacacctggccagaagaatagatttaatggacttacaattctacgtggctgggaaggcctcacaatcatggctgaaagcaaaggagaagcaaaggcatgtcttacatggcagcaggcaagagagaagtgccgagtgaggaacagggaaagccccttttgaaaccatcagatttcatgagaactaattcactatcattagaacagaatgggggaaactgcccccatgattcaattatctccacctggttcctcccacaacacatggggattatgggaactacaattcaagatgagatttgggttgggacacagccaaactcacacttggcccctcccaaatctcatgttctcaccattcaaaacaaaatcatgcccttccaagagtcccccacagtgttaactcattccagcattaactcaaaagttcaagtccaaagtctcatctgaggcaaggcatgtcccttctgcctacaagcctgtaaaagcaaaagcaagttagttacttcctagatacaatagcggtacaggcaatgggtaactacacacattccaaataggagaaattggccaaagcaaagggcctacagtccccatgcaagtctgaaacccaatggggcagtcattaaacctcaaagttaccaaatgatctcctttgactccatatcttacatccagggcatgctgatgcaagaggtagctcccacagccttgggcagctcggcccctgtggctttgctgggtacagccctccttctggctcctttcacaggctggcattgagtgtctgtggcttttccaggcacacgatgcaaggtgttggtggatctaccattctgaggtctggaggatggtggcccccttctcacagattcaccaggcagtaccccagtggggactctgtgtggggggtctgaccccacatttcccttccacactaccttagcagaggtacttcattcattagggctctgcccctgcagcacatcctctgcctggacatccaggcatttccatacatcctctgaaagctaggcggaagttcccaaacctcaattcttgtcttctgcacacctgcaggcccaacaccatgtggaagctgccaaggcttggagctgccattctctgatgcaatagtctgagctgtatgttgatcccttttagccatagctggagcagttgggacacggcaccaagtccctagactgcacacagtgggggggccctgggcccatgggaccattttttcctcctaggcctccaggcctgtgatgggaggggtgatgagacatgtcctggagacactttcccccattgtcttggtgattaacatttggcttcttgttagttatgcaaatttctgcagccaacttgaatttctctccggaaaatgtgttttgcttttctactgcattgtcagcctgcaaatttttcaaacttttatgctctgcttcctctttaacacttactacttagacatttcttccactagataccctaaatcatctctttcaagttcaaagctctgcagatctccaggggaggggcaaaatgccaccagcctctttgcatagcaagaatgacctttactccagttccccacaagttacttatctccagctgagaccacctcagcctggcctttattgtccatatcactatcagcattttggtcaaagccattcaacaagtctccaggaagttccaaactttcccacatctttctgtcttctgagccctccaatctctttcaaactttcccacattttcctaccttcttctgagccctcccaactgttccagcctctgcctgttacccagtcccaaagttgcttccacttttttgggtgtctttacagcagcgccccactacccagtactgatttattgtattagtccattctcactcaactataagaacaaacctgagactgggtaatttataaaggaaggatgttaattgacttatagttcctcagggcgggggaggcctcagtaaacttacaatcatggcagaaggggaaacaaacacatccttcttcacatggtgacagcaaggagaagtgccaagtgagggtgggggaaagttccttataaaaccatcagatcatgtgagaactcactatcagaagaataggatgggagaaactgcccctcatgattcaattatctccacctggttcctcccatgacatggggattatgggaactacaattcaagatgagatttgggtggggacacagcgaacacatattgctccagtaaaactatctcagatttctttggaaacagaaataatttattattaattcaaaattaaatactacatatatatgtacatatatgtgtgtatatatgtatatatatagagagagaaagacagagagagagatacaaggaaatgagagtcatattaacatcattaggaatttaatattactagaagacagttcagaataaccttaaaatcccaaaagaagacattttgaagaaaaacttgatactcagttctatccaagctatggcaccaacatgaggttaagattctttttgtacgagagatggtcaaaacattaccattcataaccccatattaaaatattcaatatgcaaagtgaaaaaggaatgtaagactggggacaacattaaacaaaggaaatgacaaacaattatgatccaaagaaataaatacataagtcaaaaaatattttcaaagtatccattggtctttatggtctgcaaggatagtttccttacatacatgtttagtaattcaattttatttaagatcaaatcacaattttttgtgatttgagataaacaaataacaagtagagggctaaaaatactatatccaaatatttcagtgagaaactggatgcttttttcctaagatcaaaagcaagataacaatatcccataacattgtactgaaagttgtagccaagaaaatgaaataaaagacattgagactggaaaaagagaagttatttgtatttgcatatgccattatcttatagatagaaaatcctaaggaattaattcaaaagtattaaaactaataaattcaggctgggcgcggtggctcatgcctgtaatcccagcactttgggaagccgaggcgggtggatcacgaggtcagcagatggagaccatcctggctaacatggtgaaaccccatctctattacaaatacaaaaacaaaattagctgggcatggtggtgggtgcctgtagtcccagctactggggaggctgaggtgggagaatggtgtgaacctgggaggtggagcttgcagtgagctgagatcatgccactgcactccagcctgggcgacagaacgagactacatctaacaacaacaacagaaaaaaacctaataaattcagcaaggttgcagagtacaatatcaatacacaaagatcaattatatttccatatatttgcactgaacaatctgaaaataaaattaagaaaacgtcttttaaaaatcaccaaaagattaaaatatttagaaaaacatttagtaaaagaagtgtaaaattatattctgaaaaccataaaacattgctgaaataaagaagaactaaataaatagaatgacacccaatgctcatgtatcagaagacttaatattattaaattaacaacactctccaattgatctacagatttagtgtaatctttgttaaatgcccaccttacttctttgcagacattgaccatatgatcctaaagtttgtatgaaattcatgggactcaaaaatgtccaagataaccttataaaaaaagagttggaaaactcacccttcccaatttcaaaatttactataatcaagacagcatggtactgggataaagatagacatagagacatattcactgaaatagaattgagaatttacaaataagccctcatatttatagtcaattgatttttgacaacagtgccaagacagttcagtggagaaagtgtagtcgttttaacaaatggtcctgggacaattgtgtttttatatgcaaaagaatgaacttggactcctaccccacctcacatataaacaaattaattcaaattaaacaaaatattgaatataaaagctaaaattataaaatcttgagaagaaaatgtagatgcaaatcttcatgtcctcggattagccagtggctttttagatatgacaccaaacgcctaagaaacagaagataaaatgtgtaagttggacttcattagaattaatatttcaaagcacaccaacaagaaagtgaaataaacaacccaaagaattagttgcaaagtatataataaatctgtaataatgaagaaaatatttgcacagcatatatctgataagaagcttgtctagtatatatgaagaacttgaagtgaataatcaaaagacaaataactcaattttaaaatgcgcaaataatctgaatagatatttctctaaggaagatataaaattaccagcaagcacataaaaagatttttgacattagtcatcagggaaatgcaaatcaaaactactgtgcaagcccacttcccaaccagtgggatgactgcaactcaaaaaaaaaaaaaaaaaaaaaacagacaaaaacaaaatttggtgaggatgtggagaaattggagtcttctcataggctgcctgtgagaatgtaaaatgtgcaccgactttggaaaatggcttagtgtttctcaaaatattaaagatggaattaccatataacccagaagtttcactcctctgtatgtatcatatatcctcataaaatcttattggtgaatgtcaatgccacattgtttgtaatagtcagaatgtccatcaactgctgaatgaatagataaaatgtagtataatcacacaatggaatattattttacattaaaaagaaagaaattactggtacctgctacaaaatgtgctcaagtctcagaaattagagtagggaaaggaagacggacgaagaatagagaaagcttgttttgttttgtttccaagtgcaaaaatctgttttaaaaatatatggaaggaaagacatgctttaaaatgttaacttttttggttttaaaaacatttttccttttatataaacttttttctctttccaaatctgctttatttataacttttatagtcagaaaaaaaggagaattttcattcaacctgatatatagccagagagaattacacataagaataggaatgtaaataagaatgatagaactgttttctgactttaaacccccacattgtttatctttaaatcacattcatatattatcttaatttttattattttctcatgctccaagtatagagacaaagtttatggagtatcgttacatgtggagatattgtgtcaagtctaccttacctaaataatgttataaaagatttcaaaaaatgtttccagacattgtcaataggataacagaacacacacttaaaaagttgtcaacagtgtcagaattataaactgcaaaattgaattcaaggacatttaaaaaattcatgcaatttcaatccttaataatattagggagcacacaaggaaattaggcagtagttcaagtctcattttgttataataacttaggaatgaagccagccccaaatggcctgagtgactgtgtcgtgcgctctatgttctggaagggaactttccctttggcacttgtcatttgaaactcaatccaatctcataagatatggcatgtttgccttattcttccataagaaatgttgtaattcttccttatgtgaatgccaaaatcttgagaggggcataaagtaatgctctgagtcactgaatcctaaaaatactgatgccacagtcaagacagagagaacatctaaagcacagtactaatattaataggagagaggaaaatgaagagtaataatgattattgaggaataactaacatggaatccttggatcccttgggttactatatgagtgtatattttatgtctgtataaattgagtaggatacaatttatgtctgtgtcatacaactgtaagtctgtgtatttttccttttttttttcttttgtctgtatttttgagggtgagagctttcagtactttcatcagatccaaaagggatacatgaaccaaaaaagatgataattatttcaccatggaaaagaagtctatcttatgaacaggctgggttattagttcaggtacatattatgtgagtttttcaggataccactgcacttccttcttgtttgcttgaacttaatgcatgaattacttgacatgcatcctgagttggaggttaactgtccttttccatttcctcatctagtgtgacttaagttcagatcaatcaaatagagtcccaggcctagatgatgcctcttctgtactttgacatatctggagaagggtctgtgaatccacacctaaagtgcatacatctagagatctcagtctgatcctgacccaaggtgggagtgagccgcttgtctccatcctttccctccactgaccccactcctccacatattttctggtagccccagagtccctgctatagccacctccacaggtgatggtgataaggtagggagaccggtgaaagtccctaacataagtccctagcatatggcctgactcatgtagaatgcattcaagaaatattgtctgagtgctttcttgcttgggacttttttcatccctgctaccttctctcccgtttactttgcttgttattgggttgagctgaggaagccatgggggttcagccactgtagtcaagatggtggtcatcagctagggtagtcctcaaacttttaatgcacatgtgactatcctaggtatctttttaaaagacagattctcattcaggaagtttggggttggggctcagattttacatgtgtaaaagttcccagatgatacaattgccgcctgtctgtgaaccactttttgataaccaaggagttagaacactgtatatcaaagatatgtagaccaaagaagctgaatgtagatgggggtaggggagttgtgagtgtgtactcacgagcacatgtatactcttggtcagttgtgggtttactttgctccatcctctgaatcccatcttaaaagcaaggattttccaagtcatccaaattaagttaggcttgaattgtgccctgggctctacctttaaaattagagtatatcacctaatagccatttttaaaaggaaataaaaacaacaaataagggaattaaaaagttgtgtgaaaaccaaaaatatagttgtaattatataaaaagagagaatagcagattgtaatgctcaataaagcatcaataggttactgtaatagcaacagaacagaaataaatgattaagagatatttaaaaatagattaataagaaaggaaactgaggttgaaatgaattagacgaaatggaaaggcatcagtgaaagaagcatttctaggtctgacctatggaagatggaataataaggaacagagaccctactcatgaaaattgattgttctggtgaagtgataattttcaaaacaatacatttaaaatttgaacagaatatactttctctgcataatgtaccatttttctgcagttcattaatggtttctcttctgttcagaattaggtatttgtcattaattaccataacatgtccaaaagtcatcaggtgaacttccctgaagtatattcttatattttgtatgactcaaatattaaagtgtacaaatagaaaaaataagtattgcataagtttccttagcttatgagaaacctgaccatgaatagtatgatccatggatattggatgtatacattgaggtggtgaaggatgtgaaaagaggagagttttcccagagcttcaatagagacagaaaggtcttggcacaagccacgtggtctctccttcagagaattagggaagtttagtagtaatatttctcatagagctggtaaattgagtaatatctcattattctgagattgtagaggatgagattcacaaagacaggaacaaaggtcctggggtataaatgggaaaagaagggaaaaattaatcttagctggataggaaggttagtattgagggagttatccaagaatcaaggttgtgacaaactgcctgaaagtaaaaatagatggagttgtaactgagatgaggtcttagcctccagtttatgttgagttccacatgtttgaatacatctgacatctttttgggaacaagctcatcacaagggcccaggtatacaaaattggccaaataccaatacctcaggcatttaaggctagattcaatagccctaaatagccataatagcactagcagaagcattaggtagtgtctggatattggaagaactgatttaactagtaagtgcaagataatgtgatacaaggcccattgccttgctaccaatagcaatgtagttagaataggctaaacagatgtaacaaacccccaaatatctagtggccaaaacaatatacaggctcatttgttgctcatataacctctccaagacagctgttcctacctccttgttggatcttctctttgtgacaattcagggacacatgctccttccattgcctggatatgcctttaactagggaaggaaaagacaatgtggaaaacaacttccacttttaaaatgctttggtccaaaagaggtgtgtgtcgcttctgctatcattgccattgatgatagctagtcacattgctaactagttatatagaaggctgaagacatgtagtctctagctgggtaaccactttgcagctacatttgtgtactattgaagactagggagaatgagtcttgatggggagcatgtcatctctgcttaatactcatgcaacagaaggtagcccaagagcgaaaggggcattctcttcttttctacacacagaacaggataacttctgtttaatgaggacctctgagaatagagtaccccatgagcatctcaggggtgccaagccattaatattggtgggactacctgcttggaggtggaccctgtaatattggtagatgcacctgtgaaagcacatatcatagcagcatgtatcagcaagagagaattggacataggaggagaaacagcttgtgtgcaaggttaaaagatttgttcatgagcacatgtgagagagaagccccaggaacaaggaaatgagaaaacaattactgcctcctacatgttcccagaggagggggctgggagagcaattaagcataaagagcattaattgcatagaagatgctgagggatcatagatttgaaagcaatttcaaaatatgagtattttaagacttttagcaagaacagacaccataggctgtatatagtttcctggagttatgattaaaggatgaaaacaacttttgtttagatatgtaggtaggtaagtaggtagatatagatagatatgagaatagtaagtttgtttaaacaaattattcattacatcatagtgacccttagtgctttttgatgatactgactgatatggtttggctgtgtccctacccaaatctcatctaatagctcccataattcccacgtgttgtgggagcaacctggtgggagatgattgaatcatgggggcaggtctttcctgtgctgttcttgtgataatgaatgagtctcatgagatctgatggttttaaaaatgggagtttacctgcacaagctttctctgcctgctgccatccatgtaagaggtgacttgctcctccttgccttctgccatgattgtgaggcctccccagccatatggaactgtaagtccaacaaacccccttcttttgtaaattgcccagtctcaggtatgtctttatcaccagcgtgaaaacagacgagtacactggcttattgaggaacagaatataatcagcctccttcattcctcactcactaaaccaatgtgctgatcatttctagaggcaaggacactccaagaatcaagaaagagccgatgatgaggctttctattattctcctggactggacgttgtctcagcttctgctgggccatagaaccctgcctctaccttgacttacccacatgttgttttggtgccaagtattgagtgctgcattttggggtgtacaagacagattggcatattgctaaaaatgtgcgaggacagaaatgacagaaactagtctgtaagattctcataggttccacttgtcttgcactcgtcatgtacaaaaatatgccaagcattgtagttcattaattcagtccttaccaaagctggtaaagcagttattaatttatccactgtaaagttgaggacatccagccttttggaaattaaataactcctccaatatcacacaagtaataaggaggttgtgcagaaattgaaaacttgtgaatttccaaagctcatgcccagctggaggttagagacatagggttcctaccaaaaatgtgttcctagcactcagcatagtgttcagcacttaagaggaaacctacagcagattgctaaactgggtatttacttacactatccaaaagtaggaaggaaacatacccatttgtttgtgaattattgtatcaaatcctattaatttcatcctaaatattaaataaaattcctaaataggaaatagcaatgttcatataaagaagcagcaaattaatttattggaatcgacacattcctcaaatggagatttggttgatattagagacttaatgtacctcccttagtgcttaatgtataacagagattccacttatcttacctatataacctaagaaatttgaatattttataaagttactttttagaaaacctgatttatttgttttccttgtcatctcagatggataccttcctctcaaaatctatttggaatttatattttcaagtattcaattaactaacatattaagcaggcattctcctgtgtaagttcctagcaacttttaccacttgtactaaaataaaacagatagttaagccaaatgagttaacttttctgaaagtgtatctttatacaacattaactatagacatggaaaatacatttattcacgttagaaataaatgcttctgtgagatctttcattttgataaagtcaaaacaccatcttattaataactactatattaattttgcagcaaattacaataagaccacactgtatagttgtgccattcagatgacatttatgaaatgctctaatttaacatggtgacatatattacctgcatcttttacacattatagcttatatcctctgagcgaaatagacctaaaccatccaaaaaaaaagagagagagagagagaataatgcaatgggaaattatacccctttgagaactagaaggactataattacattgcttcctcttaaaaccattcaaatatgtaaccattgctgggaacagcagtatgtggggaacctctttacactctttctgtcttgaacactcaaaagattgagaaaaaaatattcctttcctactatagttttatttgagcatgcttcagaattttacctttttgcacactccttagagattatcgtggggaagtttagaaagcagtttcttggaaatgccttttggaggggaagaggagctataaaaatataccagcctgacaaatgacaggcattgtagactggaaaagaaaagacatcttggttttacaccaatgtagaagcttttctttgcaaatgagtatttttgacagctgagcaagatgataaacagaagtatcacaaaacacttaaatggaaacaagtattatgatgtactttattcacctggcattctccaattcatgacatttatatgtggcagaacccactgcagattcatttatttatttttgaagtggaatgagttccttacgaaggtagcctgttacattaatgtggacttttcttctctagatgcagaagcttaaggaaaaaagttattgtatctgtactataaataagtggtaagtctcagaatccacatcttagggctgagaaggctcctagcaagtacaatatactgtataaatatagacaaataaatatagatatagattttttgtgtaagcaccggcagtgttgcaaatgattagatatttcataaatgccttttctaaaaaggtattgctgaaaccagtctatttctagaacttatattcagatgtttagaggtataaatgcttcaatattggctaagcttagaaaggctatgtttctctgaggctcagtgatagacataccaacaatttgatgagatgcatgactaagaagaaaaagagagtaagactgagtccctgtgaattgattgacttggtgcagtggcagagtaggtagcaagtattaaagcaatagttcttaaatgttagtgttcataagaatcatcaacagaactttttaaaaatgaagattcctaggttttaactttagcgacttttaattctttaggtctggtatatttggttgtgggaaatcaaaagactcaacttcggaatacactgaacagttgctgactatagatttgtatattcaaaattttttggtatttaaaaatggtatgtatggtttattgagtcaaatattttaaaaactatgaatgtgtgctggtttgtttttttttttttttctggattggaggacaatttggggtaagcattctctatttaacaagtcataattaactccctgccaaaactaagtagaaattgtgatttctataactcctatatttgataatatctcctaaaaatatttcagtgatatagcatttaattgcaaataattcatctagtcaccaaacaaatgtagggacgttcctatataccaggcactgtgcatatcaaggtgtatattacagtgaataacagaaacactcacgaagtgttcaattgaatttaaccttgaaatgtattatttattattattatgtttaaataaactatgtgaggtttttttttcattgccaatgagaaacccaccctaacttcagaatttttatctttaagtatatcctattttaaccacccttacccatccactctcaatgatttctcctcagtgtggggccttgccgtggaagtgtgccctggtcagtgagttttgagagtccgtggaagctagattgccctcggctcttcagttcccactgcagaactcttgcagtcactggctattggatcagcagaacctcttctattttcagtcgcccattttcaaattggctcactgaactttaggttctccagttttcaggtctttcaaaagtccgacacccctttactatcatctgctttctcctacacaggggctaatgccatgcaggttttgtgactgctggtggtgtgttcctacctgctttttttgggaggcttctgggcacagctggtcacctagtttcattataatcatttttaatggctttgctgttgttgtgttgctgtttagttctgtcagcttttatcctgggatttagagagacccaagagttctgtggccacataaccattgatcctgattcccctggagtctcttttgacttttactgcctaatttaagctgaacatatgaaatacatgaaaaaactgaaagctcaagctcgtttgttgtttgtcttcctaggttatggtttccatttctccctctttctcaacctattttgccaatcaatgtctatccttccttcactttttgcctactcactacaatattcaattacacaaacataatttttcctctgcccaccccagcaccagcatttttctgggagtttaagtctcttatgaatctgggaagaaaggaactaaaaatgagcagggatgaatagcaaaatgagtgagtcaacgagtagcaggcaggacattagagtgaagctgttttcttacccagaagactgatgatgggaaaggaaaaaagaacaattcaaaattagtagaagaaaagaaataattaataaaacatgagtggatattaatcaaatagaaattggacaaaaaatagtgaaaatgaacaaacgcaatagtttgtcctttgaaaaggttaataaagttgatgagcagaaaacacaaagtaccaacatcaaaaacacaaattaccaacatcagaaatttaaaaaagagacatcaatgtcgttgcacattttataaacattaaaaaattacagttttatgaacagctctgctaataaatctgatgtcctgaatgaaatgaacaaatgaacacaaaaccaacaacaaaaaatagaaatagcctcacatatattaaagacatttaattcatatctaaaaacctttcaacaaggaaaatctcagtcccaaatggcttcactaatgaatttgccactaacataaaggaataaataatattagtcctacacaaactctttcagaaaaccaaggaagggcatatatttctcagctcattttgtgagggctacctaactttaatcccataacctaacaaagcactaaaagaaaagcccattagaatattccatatgaacatagatgtaaaataccttaacagcatattagcaaatggaatcctgcaatatataatagggtaatgcatcatagctgattggatttctcccaggaatgcaaagttagtttaacatctgaaaatcagttaatgtagtaagccacataaatagaatacaaaagaattcccaggtaatcatctcaatagatcaaaaaactttgaaaaagaattcaaaacactttcatgataaataccctctgcctactaggaatacaagagaacttcctcaaactgaaaagggcatctgcaaaaaccctatagctaatattatgttaacaataaatgttaaattttttaccactacatcaggaacaaagcaaggaggtttgctcttataacttctactaaaaattgtaacagaagtctaaagtaggacaaaatgaaaaaacaaaaagccatgaatatcaagaaagaagtaagactattattatttgcagaaaatatgccactgtatagacagtgggagtataaaaattgcttggcaagcatcaagtcccccacatacaatcccctcctcacactactctccttcgtaaagccatgaaaaaccgctttatattctaagtaaggacgggatgtttgatgtgcaaatgcagctgtaagataaatccctgagcaacatttttggccaccctgcccttcctatagaaagtctggggctgtcactgaggtagggttagtaatggtatgtgagactggagagatatgtggaaaccacctcatggtatttggtcttcactagttaggcaatagggagctattgaatatttctgagcacaggagtgacacagaggtgtaccaagtaggtaagaggcagtggaaacaatctacctcagtggggaagagtattgtatcacaaaatttgtttagaattgctagtacttggtgataattaaaagcaaaacaattttaactgaatcttattattttaattttacttacagaaagtgcatcctcttttgtgtacccaggtgtttcattctcaccaccttaccgtaggattattatcatcagaattaaagtagatgaggcaaggcacagtggctcatgcctgtaatcctagcactttgggaggctgaggcgagaggactgcttaaggccaagagtttgagtttatggtaagctatgttcgtgccactgcactccagcctaggcagcagagtgagaccctgtctcttaaaaaaaaaaaaaaattggaatgaatgaaaattaattgatagcagtttattaaatggattagggagaggaacagactggtagatatcattcagtatacaatagctggttagtgatggcaattctgaaagaagaagtggtagaaactgggaggtgttgctagtgtagtatgacctttcaaaactcacagagtgcatagcttgtggatgtatagaacaatgtgaaagaataaattctccagaaaggaagaagaggagttagagattttataaaagagaagtctatgatgttctctaggaaagaaaagaattttctgaagaatatatgcattgattaaatgatttccttttgccctcatttatatttattttctgttcaaatgaaacacttaaactaacactcaatttccgggacagatttcctgttcttacattcttcaatttgctttttaaatttttactttgtttagcaatatcaacattgcctcattggcttttagtgagtttcttgagaagatgtaatctatagaacattagttcttctctcccaccagacagatgagtgcatagaaagacatatagttatactgctgctgttttaaaagtgttgcttcaaattacctaaaatatagtgactattagataatcactgataaaaactgtgttcatctaatttattcatcttgaaatcatgcttcatatttcctttaagcacaaaatagttatgttcacacatgcacaataaatcatatatggattacttgatgccttgaattcaccctcatagaattttatctcctaatgtaaagaaaactgactggggtaattattgcaggatcttactcttttctgttgtcagtaaccttcccaccaaactcattgtgacaattgtcacccggttgactgtgcatatccaccattgctccagagcctaggccagcagacttttgctgcatggtccaaaatggtgaggtcctgggtgtgatcacaaggcaatatgcagcaaacattagtgaccatcagtgctaacaaagaaacttacaaagtaacaacttgaccacttggccaattcttccactgtgttttcagctcttcacaggtgtaggccatgccttaaacttaattgagtctagcactcttcctgttactattattatatttgtagcttatgataagcagagtgaatttaacataggggttatgatcatgcatttgagagttgggccacttagtaactgtattagtccgttttcacactgctgataaagacatacctgagactgggtaatttatacaggaaaaatttatacaggacttacagttccacatggctggggaggcctcacgatcatggcagaaggcaaagaggagtaagtcacatcttgtatgggtggcagcaagcaaagagagagcttgtgcaggggaactcttgtttttaaaaccatcagatctcgtgagatttattcactatcatgagaacagcacaagaaagacctgctcccatgattcaattatttcccactgggtctccccccacaacacataggaattcaagatgagatttgggtgaggacacagccaaaccctattggtaactgcaccacctttaataagtaatttgatctttctaaggtttaaattcttcttctgtcaaatgaagattcatgtattttcacaaataataaaatgacgaaaattcctgccactatggagcttacattgtaaagtgatttggggagttggaagagaaagaacaatcaataaatataaaaataagtaagtttatttactaagttaaatgctataggagaaaactagacaaagtaaaatgccttgagagtaccatattaaggaaaggaattgcagttttggaaatgtagccaagagacttttaattgaaaagatggcatttcacttgagacctgaaggagatgaaggagttagtcatgtggaaatctggaagaagagacctaggcagaggcagcagcctatgcaaacaccataaggtggaagcacccctgatgtattcagaaaaggggctgtatagctgaagtgagcagaagaaagagtaggaatgtcccaagcctacgggatccttgtgcaagctgcaaataattggtcctttcactttgcaagtactgccccacatccatcaaatactttagaaggtttgaaaaaagtttgactatcaatcacttgatgaattttcctgcccactatttgctctataccagtgtgaaatgtacagagtaatacttccacttcatctttaccgagcacttactatgttccagagatgatgctaaacatgtttacattaataatctcagttaatcctgacaacagacctatgaggtagatattattatgctcattttattgataaatacgtgaagacttcagtagatttaagttgttcagagtatagttaattctgtggctagtaattgtggcacataatcctaatgttccaggaatttatatcatttagttgaggagacactcctcaactcctgtctcaggtgacaggagtaagtgaaattctaaggcacaatatagcatggtgcataagcaggcaggactgcagccacagaaccctcaattttaattcaggctaagtcacttactttcccttttatgttagagacgtctgttagtttttctacaggaagtataatacctcacagggtaatttattcacaaatacgaaaacatgtataaaacatcatagcagtctgcctgcaatatcgtaagtgttcaaaagggttgtggatattattattgttgttgtaagctaaggaacgctagaaaaacatcaaagattcaattactcaaaataacttttgctgagcatctactacatgtaaaatatgtatactgtgggatcaatggatgatgtaaaggtgcaaaaggttctggcccttggggagtgtatggtacactgggaagttatattttcagacaagacataataattctaatacaagctagaccttaaggaattgaatgacagaggtaacaagaaaatgctgtaaaatggctgaggagagaaaaatcctctaatttgggaggagctcagtattgacaaaggctagaaatgggtagagaacactttcccaaaagagatgtcgtggtgcctggtgagacaggctgtgaacttgacttctcccatccgttccattattaatgtgtgtctctgtgctctagcattcatttcatcttgtggacatgctattgtttccatttaaaaactctcttgatcacaatttcttctgtggcgatggtctcatgtcctgctctcctttttggcaaaactccttaaaagacttgtctaggctcatgcctccaaatcctattctgctattatttcctggaaatatatctgtcaggccttcactctcatcattactttgcaacttttcttgttaaggtctccaaggacctctgtctttttaaacaaagctaaattctgtcttcattgtatttgacatacaagcaggatttgacacagttgatcactctcttttcatttagaggactccacattctccgggttttcctcccatatccctgactatttcttctgtatcctttttctgtgccctcctcttacctttgaacacttattgttggagtgctctggaactctctttagaggactttcctgtatctacgctcacgcccttggtgatattttacttcaaataccaattatacacagacaatactcaaatgaatttcacaatcatatttccaattaaacacttaacatgttttatatatatatataaaatattatttgaatttaattatctttatcttcacatcaatacataataatctatcagcaaatcatgttggttctattttcaaaaatatccatagtctttcattcttcctagattcaataattcctttgcttgtctatttagttttctatatgtcattaatcttcctcatgctgacgtctttgctacatgaatatatacatatatatggtacacatacatatatattttatgcacacacacatacatatttatgctcaaggacctcctgccctgctatcagcctagagcttttcatatacctctacatcctcatttcctgaatcccatgccttccattcttgttgctgttgtctgtttactttctttttgctggaactatattactcaatagcttcctgatataggaagttaaagttttgaatccttgcaaatccagaaaatgtttgtattctttctttacaggcaaccgataatataacttagcatagaattctggattagaaataactttactcataatttggaaggtaccattcttagctttttagtttactataatgttgcagaatactgcagtgatattctgtattttctatgtgacttattttattggtctctggaaatttttgtttcctttttatttttggaatttgaatgcttcatgagattgcaccttgatctgggtttttccaccagcatgtggtgagccttttttttaactttttaatattttatttttaatcaatcaacacataatatttatacctattatgggatacagagagatatttcaatacatatgtaaaatgtgtgagtatcaaatcagtgtaattagcaaatccattaccaccaacctgtatcatttctttgtgttgggaacattcaaaatcctttcttctagctatttgaaaacatataataaattgttgttaactatagtcaccatacagtactataaaacacaggaatttattcttcttacctatctgtgattttgtatctgttaaccagcctctccctatccccttctccctgctatccttccaagactccagtaaccactattcgaccttctactttcatgagatcaactggtttagcttccacatatgagtcagaacaggtaatatttatctttctgtgccaggcttatttcacttaacataatgtcttccgggctaaacataatgccctctaggctaatccatgttgcttcaaaagacagagttttattccttttcatggctgaatagtatttcattatatatttatatatgtgatatatgatatatatatatatatcaaattttctttatctattcctttgctaatgagcacttaggttgattctatatcttagctattgtaaatagtactgcaataaacatgggagtgcagatatctcttcaacgtactgatttcaaaacgtctggatatatgtacccagtagtgggattgctgaatcatatggtagttctctttttagtttttttaagtgaccttcatacttttttccataatggtatgctaatttacattcctaccaacagtgtataagaattcccttttctctgcatccttgtaagcatttgttattttttgtcatttttataacatattttaactgggaaaagataatattgtggcttttgtttgcatttgtctgatgattagcaatgttgagcattttttcgtgtacttgttggctatttgtatgtcttcttttgagaaatgtctgtccagaccatttgcacctgttttaattggattatttggggccattgagttgattttcttatatattctaggtattaaacatttcttggatgaataccttgcaagtatttttccattctgtaggtcgtctctccactttgttggtagtttcttttgctgcgaaagggcattttagtttgatgtaattccatttgcccagaccaatgtcctgaagcacgtctcctaggtttacttctagtattttcatagttttgggtcttacgttgaagagtttagtccattttgagtggatttttgtatatggtgagagacgggggtctattttcattcatttgcacatggatagccagtttccccagcaccatttattgaagaggatgtccttttcccactctttgtttttggtgactttgttgaaaacccgttggcagtaaataggtggatttatttctgggttctctattctgttccattggtttctgtgtctgttttacgacagtatcatgctgtatagctttgtagtaaattttgcagttaagtagtatgatatcctcagtcttgctctttttgaacaggtgactttgtctcaagattgatttgtctagctcagtggggtggctcacgcctgtaatcccagcactttgggaggctgagttggacagatcacttgaagtcaggagttcgagaccagcctgaccaacatggcgaaagactgtctctactaaaaattcaaaaattagcagagcatggtggcgggcacctgtaatctcagctactcaggaggctgaggcaggagaactacttgaacccaggaggtggaggttgcagtgagccaagactgtgccattgcactccagcctgggtgacagagagagaccccacctcaaaaaaaaaaaaattgctttgtctattctgggtctttatggttccatgggaatttaaagaattttttcttctatttctgtgaagaatatcattagtattttgataggaatcatattgaatctgtagattgcttttgataatacagtcatttttataatattagttcctctaatccatgatcatgggatgcctttccattttcttatgtgtcctctttaatttctattataagttttatagttttccttgtacagaacttttaccctttggttacatttattcctcagtatttttgtttttttagctatcgtaagtgagatttcatttttacctagtttgtgcttgttgtataggaatgctactaatttttatatattgatttgatatcctgcaactttattcgtttagtttatcacttctaagagttttttggtggagtgcttagtttttattacatataagatcctgtcatctgtaaaccagaactagttgacttcctcctctccaatttgtattcctgttatttctgtctcttgcctaattgctctggctaggaatttctagttctaggttgaataaagagtagtgaaagtgggcatcaccatcatgttccagttcctagaagaaaagttttcaccttttctccgtttaataagatgttggttgtaggtttgtcatatatggcctttattattgaggtacatttcttccatactaatttgctgacagtttttagcataaagggatgttgaatttcatcaaatgctgtttctgtcttttgagatggtcatatggtttgtccttcattctgttgatatacttttatttatcccatttattcaatttgctcatattgaatcattcctacatccttggtataaatcacacttgatcctggtatgtaatatttttgatgtgctgttggattcggtctgccagtattttattgatgatctttgcaactatggtcatcaggaatattggcctgtagtttttgctgttgcatatttggttttgctatcagggtaatgctggccttataaaattagtttagaagaatttcctctccttcaattttttggaatagtttaagaaaaaatggtattagttcttctattaaagtttggtagatttcagcagtgaagccattgatcctggacttttctttgttgggagactcttaattactgaatcaatctcattacttgtgagtgttctgttcagtgttctattcctccttggttcaattttggccagttgtatgtatccacaaatttatccatttcttctaggtttttcaatttgttggcatatagttattcataatagtctccaatgatcaactgtatttttgtggtttcagttgtagtgtctcctttttcatttctgattttatttgagtcttttttctttttttctcagtctagctaatggtttgtcaatattatctttcaaaatatcaactttttgttttgttgagcttttgtattgtttttggtctcaattttatatccttcttctctgatcttttttatttctatattgtgccttgcagaggacctttctagttaaatacatttgggaacttttgagcttcctggatctgggtatctatgtctgtcccaagacttaggaagttttaagttagtatttcattaataagtttttattaccctttttgtcatcttgtctttctaagctcccacagtatgaatagctgtttgcttaatggtgtcccacaagtcctgtaggctttctttattctttcttattctgttttctttttctttctgtctgcttgagttatttcaatagacctgtctttgagttcataaatcatttttttctgcttgatctagcctgttgtcaaaactcttgattgtatttttatttcattaactaaattgctcagctccaatatttctgtttggttcatttttatgataccaatttcttgttgaatttctgatttagatcatgaattcttttcctgatttttttcagttgcatatctgtattttcttctatcttgctgagtttccttaacatcattattttgaactccttttctggcattttgaaaatctcttttactttggggtctgttactagaggattattgtgttcctttggtagtgtcatgttttcttgctttttcatgtttcttgtgttcctacattgatacctgcacatctggtaaagtaattgcttcttttaatgttatggactagcgcttatagggaaagatttactcctgtagataagttctagagtgttaagtagagggtgataacttgggtcctgagtgggcacagtagtgtagtctctgtgaagtttcttcaactgtaatccatgtcagtaatgtttgtgaatgcttcactgacctaacctgtgggagtttgtggcagcagtgacatgactttactggaatcaggcttattgagtgagttatcaggatggaggcatgtttgtgcatgtgatgggtcacctagcttaggaactggcttgctttgggtgaagccgtgggctgtttctcaggccgggggcatgagtgttcagtggatcagctggttctggaactggttcaccaggagtgaggctgttgggtcgtttctcagtttaggggcataggcacatgttggtttgccagccattaagccttttaaaactatggtttcatgtctggaaaatgtgtattttatactaattctttattaacttattcctttaattttttttccttttggtgtatttctgaaaatttgttttcatctcattattattgttagcctttctgatgtattttcttatctttctcttctaatcttttagttgagatttttttccagcctttttttttttttttggatatagaatcttagtatattgtctaggctggactcaaactcctgggctctaacaatacttctacctaagcctcctgagtagctgggactacaagcacatgccactatgcctggctgtatatttttaatatttaagaattctttctttcaccaattgtttattcttttaggcttttttttgtttctatattttttaatgaatgcaacttttatcttctggggataacagagatattttattaaattgttattagttgatgatttcttccatctctaattccctgcattgtttgtttcctcatctggattatcatttttcatcctcctcctttatttttgtttctgtcattcacattgtatattttgcacatttgatgaattttgccatctgctttattctgtagagaaatggtaaaacatttccaaaatggcctttactcatgtttatgagcagcaatacagctttactttgcagaggttaaaagctcaaatattagttctagagttcttatctttgtagtatttttctgccagtttcctctttatggaaaataactctggctcccggctttctttaaactgtgtagaaggggagttgtggtggtaaaggggagaggcagtgtatacagactttcacttaatcctttcatgtctaccttgtgcctcttccaataacaagttgttgatgttccaatataatggagctggttaatttcaattattcttgacaataagactgatgtcactgtggagtaggattagtttggctggctgagtggggttgaaaaggggacctgaaaatctaaatactttctatgtggaatacctctaattcatgattctcaaccttggcactatggctattctgggctgggtaatttgttgtgagggatggatatgtgcattgcaggatgtttagcagaatccctggctacatatcagtatactacatgccagtagaactcctcccctcactgggacaaccagaaagttcctctggggacaaaatcttccttagctgagaaccattgtttaactttagacctgtgtgtgtcctcttacttctctcaatgtttcattatcttcaagtcttaaggctctcaaagattctataggaaaaatcagttttcatgttttaggaatccaattcagctagcactcaagctgtaacttctctgattattcaagaatgttgtcaatatttatttctatttcttaatttcattttctgtcttcaaaatttttgtaaaatgtatttcttccctattgatttctctgctggcctcattaaaattatgggttatattttttaaaattcctatttttttaattgaagtatcaagaaaaagaggaaaaggcacatgcttgatctgaactttatcaaaaattggtaattgttttcatctcttactattaactcttttttaaatcgatcctcttgctttaggaatccaaatcagcctgcactcgtactgcagtttctctgattagtcaagaacgttgccaatatttatttatatttcttcatttcatttttcgtctttgaaatttttgaaaaatatatttctccattattgttttctctgctggtctcattaaaattatgggttttacttgttaaaattgctgttattttaaagtagtgagaaaaagaggaaaatacatgtgcttaatctaaattttaccaaaaattttatattttagtaaatgtattcagatgcatatttttctgacaatgggcagtcttagttaacacctgtatcctttttcttgagcaagaaaataaatttattataatttttacttattctgccctagtattcctcatggataaatcgtgtcttaattttattaatctttgaatgcatcaattctaataagttggatcctttgtcagaaagcagaatgtgtacaatatacttatcccttagttttgtcttcctgggaactggctcttgatcacaataggatatatacctacagatcagcttcattataatttaatttactgtatttggcagcaacatcttctagtggtaacctagaccgagatgaaatattccatttcaattgacagttataaagctacagaccatagatttcagttatttgagtagttactacattaaaacacatctttttttcccttcctttgctcccaaccacatgtgcagcaaccagtatgtttctaaattttgctcctgtttataatgctatttcttaagcttctaaacatcgcagtgtgcatttcacctctgctaatctccatccaaattctgctatgttttggagtttgtaagaaagtgtagtgctgatgaggggattgaagtttcaggattccaattttggctgcttaacaggaacagttgaaggatggcatgaggtttttgatccatggttttccatttccctggtatagtaagcataggtatcactgccaaacttctttggagctctatgttatttgggttgagagcttggagctatgttaaacagctgaataaatgtttcccaatgcagctctgtctatgatgcagctcctgaaaattctctctgaatgttgtcaactagttttctcttaaattgagtttatagttgttttgtcaggtccaaatgtctttttgagactttactttgactgaacattgtgatagaatttatcctcctgcttgaaatgataaaaatatggacaaaatgtattaaataattgtttgctagatgttggacatcaggcaatgaggacaatgtttgctgagaaataggaaataaattatgtgaatcttacaattgacccggattactgcttacagagtatttctagaccacgacttagggagagaaatcccagatggagctcagagagttctccaaattgaagagatatagccaagtgtttcaggaattcaaagtagttagagtttgcagagagcagatagaggaacacagagataatttcacagatctacagagcatcttccttaagaattcactttactacggttcactgcatgtatgaggctgcagaaagcacaactttcaattattaaaagtaacaataattaacactcatgtaatgctgggtatgtgcctatttccactagctgaactggcgagaaaatttatgattcgtgggatatttgataagagtacacaaaagggtctagcctcaacagtggagaatagccctaggctgataactacttcaataccacctaataaatcttaagagcaagactcaaaaggaactgtttccaagtaatttaactgcatccaagaacaaaacacaaatatatttgtaagaacactgaaatatgtagtacctaacaagaaaaaattcacagtctctggcaccaaatcaaagattatcaggcatgtaaagaagcaggaaagtacaacttataatgaggatgtaaatgcatcaatcaaaattgatccagaattgtgagaaatgttagaattatcaggccagtatgttgaaacagatattacaactctacatagtttaaaagctacataaaaatatggaaggtactaaataaccccacagatcaaaattccagagaaaaacctacactgtatggaatgaaaatacactggatataattgattatacattaaacataaaacatttatgttatatataaaaaattagtgaacttgaagtcatagcaatataacctatccaaaatgaaacagagttgaaagagcatttgtaaaaatgaaaacagcatttgtgagctgtgggacaacttttagaggcttggtatatgtgtaattggagtccctaaaggaatggtggggtggaggtgggaatataaaaaatattcaaataatttatggctgaaaaattccaagtacagtacactgaaaaccataaagccacaaacccatgaatctcaagaaaactaaaaaataagtaacatgaaggaaatcacaaaaggcatattataattgaattgctcaaagctagtgataaatttttaatgataaaataaaatactacagcagccagaggaaaaagacgtgttaaatacaaaggcaaaacagtaagaatgacaacagatttcctatccaaaataatgcaaagaagaagacagtggggcaacattcttataactatgaaagaaaataaatagtgcacttatgattctatatctagtaaagatatctaagatgaaggtgaaataaaaactatttgcaatacatataatgaaagagttcatcacacagaaacctatactataagacacattaaaaagaagtccttcagtaggaaataaaatggtatcatatggaaatatggatctgcacaaagaaacaaagagcacccaaaatggcaactgcattggtaaatacggagggtatttttctaatgatttaattttctttaaatatagttgacagtttaaaaaataataataatatagtaaaagttttataacatgtgtaagtaaaatgtttggcagtaataacacaataattaagagggggaaaaggaagtacccttgacccttgaacgacatgggagttaggggcactgattccctgcacagtcaaaaattcaagtttaattttgactctccaaaagcttaactactaatggcctaccattgaccaaaaaccttactgataacatgaacagtcaattaacatttattttgtatatattatttactgtattcttaccataaagtaatctagagaaaagagaatctttaggacaatcataagaaagagaaaatgtatttactatttgttaagtgaaagtggatcataaagatctttgtcctctttatcttcactttgagtaagatgaggaggaggaataagaggaagaggagagattggtcttgtggcctcatggctggcagaggtggaagaagattcttttataagtagactcatgcagtgataacccatgttgttcaagggacaattgtataccgttgtaagatccttatactctatttgaagtagtctgtcacttaaagctaggctgtgataaagatgtaggataaaaaccactaaaatcataaaacaaagagttataactaataaaccaacatggagataatttgaatcataaagaaatataaaataacacaaaacaggcaaaaaaaaaaaaaaggaaaaaagaaatcccaagcagatgggacaaataggaaatatcaagataatagatttaaacataatcatatcaataataatgctaaatttacatattctaaatactccacttaaaatatacagattggaagattggttaaaaaaggaaaaagtacaacttaactatatgctgcttacagaaaagatatttaagtataagacacaactaggttaaaagtaaatgttggaaaagataaatcttgtgaacactaatcataagaaatctagggtgactttattaatatgagaaaacatgaatttttagaaattttgtccaagataaaatattgcccaggatgaagaaagtaatttcattttgcaaaaggagtcattttgtcaataggacataacaattcttaatatttctgtaccaacagcagagcttcaaaatgcacagagcaaaaactaacgtaactgaaggagaaagtaaaatccacatttgtcggcaaaaatttcaatacccttctctcaataattaatagaacaaactgacaggaaataagtaaatctatagattagaacaacactgtcaaccaacttgacccaatggccagttatggaacattcaacccaacagagcagcaaactacacctacttttcaggcctacacaaaacatctaccaaaataaatcaaattctgaaccataacacaagcctcaatagatttaaaagaattcaaatcatataaagtacattatggggctgcagttaaattaaattagaaatcaataacaaaataacctggaattactctaaatatttggaaactaactaacaaaattctaaataatccaagattagaagaggaaacccaaagaggaattaagaagtattttgaactgaatgaaaatgaaaacacagcataacaaaattgtgagatacccaatatggcaggacttagtagtatattaatagcactaaatgcctatgctaggaaaggatgaagatttcaaagaaatatcttctactttacaaaactagcaaaagaagggaagacccaagccaggctaatgaaagctatttctgagtttctaactgcatctcatggggatgatcatttcttttctctgctcttgtggctgaaagcatgttaaggccaaaattgtgattcaggcaagacccaaatttataagaccaagattgcattttaagccataaagagcaggagaatctccatggcttgaactgtgaatagatatttgtttgttatcagagatagtaattgtactgctttatctgtatttccttccatgttagtaaaagaaagctcagaagtagttgatcacatgatcatagagaataaactacatttctcagtctccttggcagctaggtgtagaaatgtggtttaagttctggtcaatgatattttatctattaacgtttgctgtttaagttagtggctaaaaacaataaaaattgcgtatttatttaggattctatggtttggctcagtgctggtgtgcactggcttgtccaacctcttctgggctctctcatttgtctgtgattagctagctggtcaagcagcagttagataggaagacctcactctcatatgtggtggttggcaagctggctgttcactgggacagtaggagcaattattagctggggcacctcagttctctgccatccaacctctaatattccagcaggatagcatgagcttgctcacaaggtgatctcagagttccaagcccagcaagaaagaatgaactctaaatttgcaggcattttaaattgtctgtttgaatcatatttgcaagcattatatgtgctagtatttggccgaagaaaaccaataggtcaatctagagttattgtggaaggatcgtaccaaagagtgtcttagtgtatttttaaaggaaaggggaatgcctttctctctttctacttcttggtggacagcaattggttttagagtatgagtagatttgtattttctcacattaaaaaggtagaatctacaactgtggaatctatagaagtaaactgggtattttcagttgaatcttgggaaactgactaaagttaacatttttaaaaataataatgctttattttatttttaaactacattttaagatatagttaatatacagaaattataatctatatgtgttacagagagattaatgaaatgggagtaaacttgttattttattaatttgtggcagagttcatatagaaagaattgtttttattgacaaaaatatctcgataagacttaggttttggcaagaatcaaggcaatattatacacttttgagatgtctgtgaaaaagtgaccatgtaaagtcaggtgtatagaaaaaagtgaatatgctttatagcagagcaaggaggaagaagagagaagccacagaagatggtagataattggagtgcaagatggtaggtaattggagtgccaatgaaaatctctagctatagggaaactaaagggatattatgaattgcaaagtaatgatttaattcctcttttaccccgaatctttaataaggtttaacgactacaatttgtttgtttgttttgaacaagacttcttgaaattgaggcattagctgagtttcacctctgggtgacatagggcagtgctggcagaagccagaaagacttcaaaatggaagaagcagaagtgtagggtcagggcgactacgaaatgatcaatacgcatagaattcttataaacttaaggaggacttctgtcattcagggatggaattagggtcataggctgccttatctagatttcaaaaggcaaggacgctccagatgatacatgcattacatgtaaataagaatacaacaaggccaggtgcagtggctcaggtctgtaatcccagcaatttgggaggccgaggcggacagatcacctgaggtcaggagttcaggaccagcctgaccaacatggtgaaactgtgtctctactaaaaagataaaaaattagccgtgcctggtggcccagctactggggaggctgaaacaagagagtcacttgaacctgggaggcggaggttgcagtgagccgagatcgcaccattgtactccaaatttgcaggcatttttaaatgtctgtttcaatcatttttcaagagttaaactccatctcaaaaaaaaaaaaaagaaaaaataacaaaacatataaaagataaaggttttgcacttttatttctctttaccttttgcacacttccttgctctttgaaaaagtattgtttacatgtaatgtttaagattattctttgacggaaacatcacatatgtccaatgccttaaggtgtttactatctctttggagaacaggactgatcctgtaaagtaccagcaaagactcaggcctgagttatgggttgatgtacttgaagtgttacaagtatgtacccacacgcctattggattttcatggtatgcctatatgttacacatatccaccaataaatgccatctatttttgtaggctgaatcaaatctctgtcttgagtaatgattttgtatcctttggactagatctgaataagactgagaaacagccaggcacaagaaggcaattcattgttctcactcatctttctaaacctatatgcatctttgatattgaggttcattattagctacaactacatttggtttgcatataaccatttatttttcagtcttagatattttcatatcaattgtcttaattatccttaaataaagcttccagtgagtctctatttcttggatgaggacaattgaggcagtgatagttctttaaaaattatttaatttctaagtccttcactatatcttgtaactgaatcccaacctagatatttttaaatatccttgaaattaaatataaatcaaataatatctttccacatgtaggttacttccctctatggtaactctgcctccaaatgtgaagagctggattcaatccaagtgaaagaaaatcagtggggaaaatgtcagggactataaaagagatttgaagtctgtacccacattgctgtgttagagtcctgagttattaaatttctcatatttatttgacattttatatacatatgtccacttatgaagagtttagttcttatctttctttaatcaacacagtattaactatgcatgtagtagatgaacactgtattttatgtatttgcattcttttcaaaccagatgcttaaagaataaaatgacacagtgttttagctgttattttgctttaaaatgctttaaaacaagaaacatttttggaatttcttatcacaatataaatcagctaagtatatttaatgtggtgaaatgaatcataaataggctgaaatagtcctaaaaggggagttgggtaagaaaaaaatgtattaggatcaatatcaataggcataaataattctattaacaaataacattaaacattgttacactgtttatgggatgatatcattatatcattatagaaagattctcccttaatttaaatacctagcatgtacaaaacaagtttaaatcaatgagacagtaaacaagaggaataaaatagagaggtgggctgggtgcagtgattcacgcctgtaatcccagcactttgggaggccgaggcgggcggatcacgaggtcaagagatcaagaccaatatggtgaaacctcgcctctgctaaaattacaaaaattagctgagcgtggtggcgggcgcctgtagtcccagctactcggaaggctgaggcaggagaatggtgtgaacccagaaggcggagcttgcagtgagccgagattgagccactgcactccagcctgggtgacagagcgagactccatctcaaaaaaaaaaaaaaaaaaaaaaaaaaggggaagtggtgtcctaaagactaaattaactgctgactattttctattttcagtctctacatatttatatttttatttctttatatagcattgaatggttaattccccatttcccttttattcttatacgactaacttctatgggttttattttcattcagttctgtatattccccctgctgaagcctcccatgttgtgtgtcaagaggaaaaatatcttattaccttcttgtctgttgaacatttagttttcttctccctccctccctgtcttgtacctaatgagcaaattatctaaaaatagatacgttcatcattctacaaaatgttgtatcttctctagattggaggacagtgtaattgtaagagacacgtgtctggcaggcagtgcaatcagtgccagaatggattctacaatctacaagagttggatcctgatggctgcagtccctgtaactgcaatacctctgggacagtggatggagatattacctgtcaccaaaattcaggccagtgcaagtgcaaagcaaacgttattggtacgtgtaacgcaaaagtttacagtcacatctctattaccatctggaataaaattctctatttgatttcttaactgaagagtaaagcaaatttctttgctcaagacaggctggaaaaaaaaacaatttggatgaaattaactgtttaaaatgattaaattaataattctatcaaactgcagcttgaagcttagtttaatcaaccctttagaagtttctttattctgtagatgcattaattcccatggtcccatactaataagtcatagaaaaatataatttgcttactgcatagatgtttcttttagaaaattagcactttttcaaaatgttttacacttaatgagttctaagcaaatcatttccatgctagttttcttaatagaccaaaataagtggattttttcaaaatattctgtgctacagggtcctttgtgataaatctttccatttttttctgttatatttctttgaactgttcctatgaaatgcaaaataagtcaacataattctacagatcatgtatattgctagggttacttacaaagggctacataattttaattttgtaattcagcaccaagttgattataataaacagctgccttcggtgttatttatcatttttttatacaagacgtgcttttttgtttgttactcccacaggtatttttcggaaattagatttgattatagcaatttattacatccaacatttttgaggggaaccaccgccacataaggacaaaatttatcaagtgcctaaaatgcactatgttcataatgcactttgaaattttgatatatgagaatattatgagaggaaagtttcctgatgaagtgagccctgtattgtaactgaatatgtcttggttcctataggaagtttaaaaaagacctttgcctttctattgtcattcaagacaccaagtcatccatggtttttctaacactgacctgaaccttacaatagtaaaaatatgcctggcagtgattacacacactcctctctctctctctctctcacacacacacacgaatgcttacatgtacacatgcatatgtacatatcattctgaatactattttcatttctgtgatatacctctaaatctaattctttatcttttatttatgtaagtgtacatcatgctacacaattcagctagacaagcgtttcaatttaataaagagaatgtaggtgtgtttagtggcattacacgagatttctctggtttaaagaaacattacatgaaaatctgtaccataatttacctatatgcatctcaagcatacagaaactaattttttagaaagaaagaataacgtgtaaagagaagtacatatttgtatgtgctatccatgatgctgaaggaattctaagaccctgaattcaatttgtatggcatcctttgttctttaatgtgagatatattttaaactcaagatgtgaaaacaaaagttaaagcaagacctttaaagacagtgaaataattacttctttgtatcaatggaatctttcttgtgatggttagattccagagcttgaggaagggaaaaatcaaaattaatttagaatgtataatgccatccctactatttgcctgttttgttgattgatccagatggttttctgcaggaaacataaatatatattttgtgaagactaaattacttcagtattataaataattattatttctagtgttatttctgcaaatgtagtactttttataaaaacaaaaacttgatatgcatatatatttactttcctaatgggatcagcaagtaactttattcaatttcaccttgttaatatgaaaaaaaaagaagcccagaaaatacaagtgtatgttgtatacgcttcagaaagcaaactgttagagttaacaaaactgttaaatcttactaatgattctatcaccagtaaaatacattagcaccaataattttattaaagtaggtcattcatctagaataaaaagggagaagaatgtgaattaaatgccaagtgtgctaactcgcctgtacttgttaacaccgaatgtgatgccctgtaggccttcctgactatcgttaggaatagattacctgtcaggaatatgtatggcatattcaaataagcactgtgcatatttttaaaactgatatgatatgaatccatgtagaccaattttaatagttcaaaatgagtcataattcttgttaacaatacagttatttttaaaatttgcagcaatagtggtccttttttattttccttattgaaattaaatgatatgccttaggtgagtcattcatcactgttaaagaacttgccttcattggagttcttgaatttttatccatatatatacatatatattatgtatttccttccagtttaggaaatgcttttctacatatgagttcctgagtatgtttttgactcttattttaagattaatttttaaattgcaattatagcttgaaataaatgtttcagttgattcaacccatgcagtgagttatttaaattcatggatatttggaaactatctaaaggaagtattttgcatctaaacatttactattctaatttttttatttctttgccttgtaatacccttttatcttttagaataaccttacttgtcagagatttaagtttaggtgataaaacatttttcttcattcgtaaaatgtatatgtgtactcctttaaatagaagtaatataaaaaacagaatttacttagtgtttaaagaggtatgttctgagtcacacaagatgacaagcaatgtgattgctttatgagccaaggagagcatgatttatattaattgaaaatgataaaatagaggagcatacaaaaggattaaaccaaaaattgccctggataagttttatttatattaattacttaaatgtgtggattcagaaataagtgtatatgctgttttcacaaaaatagttatcagctgacatttttttcttttttcccagcttcacgaaggtataattaaataaaaattgtatatatttatggcagacaacatgatgttttgatatatgtacacattataaaatgattaattccagctaattaatgtatccatcacctcatgtacttatcatgtttttggggtgagaacatttaagatctaatctcttagcaattttcaagtatacaatacattattattaagtatagtcaccatgctgtacaatagagctccagaacttattcattctgtctagctgaaactttgtactcagcttaaccttttattaaacatctttagagatttcttatctttagaaaaacaactaatttgttatatgtaattctactataattttaaatgagcacatttgttaaaatagtttttaagatttgttaaagagaaaaagagctccagcatatgtaacagaaacaacatttgcattaagcatttttctttgcattaagtaataattaaaaatttatgaagttcatcgcaaacagttgtatattaaagctaaattaaatattgtcattgaattttgagagtaagattggccccctatggcattgcttgtgagaaaacactcaatattttgtgttcgtatcatctgcagtagcattgtttgtgtctcgtctatcttgaatgaaatcattttcccatcctcaccttttaaatatattttatctttagggcttaggtgtgatcattgcaattttggatttaaatttctccgaagctttaatgatgttggatgtgagccctgccagtgtaacctccatggctcagtgaacaaattctgcaatcctcactctgggcagtgtgagtgcaaaaaagaagccaaaggacttcagtgtgacacctgcagagaaaacttttatgggttagatgtcaccaattgtaaggcctgtgactgtgacacagctggatccctccctgggactgtctgtaatgctaagacagggcagtgcatctgcaagcccaatgttgaagggagacagtgcaataaatgtttggagggaaacttctacctacggcaaaataattctttcctctgtctgccttgcaactgtgataagactgggacaataaatggctctctgctgtgtaacaaatcaacaggacaatgtccttgcaaattaggggtaacaggtcttcgctgtaatcagtgtgagcctcacaggtacaatttgaccattgacaattttcaacactgccagatgtgtgagtgtgattccttggggacattacctgggaccatttgtgacccaatcagtggccagtgcctgtgtgtgcctaatcgtcaaggaagaaggtgtaatcagtgtcaaccaggtaagaaagaaatgtattacattttcagtgcacaatgacattccttttgttaacttaggtaacttctccctgtttctggtttgtggcttctacaaattttatttccaaaatcattactgtatttatatcattatccaacacatatataactatttaacttattcaaaattatctgcatatttatgttactattttgagaggatactttagataaaactcagccgatcggatttatttcataattgagactcaatttctacacttgaagtaaatctcctttttaacagttttttaaaaatcagatcaacaagagtcaattttattttccagagaaaggaaaatttgagttgaatatccatacaatgccaaatattcaaatgatgaactaaatctctgaataaagctggctaaatgtttttgctgaagaggctatatgttctagttttatatagaaatacctagaattgtttccacatgccatcaaattaataaaataggccactgtttaatctcattatatacaaacttatctttccatctctttcccaattgggagagggatagaccccatctatggctctccttacatttaagattttaactaaaatactataccttctttacaataaattcattatgatatgatgataaatataagtacttatccgttgtttaacagctgtgctaattgttgtcctgtcagccaatattagctctgagttatatgggtctataaaaatgagcatgataccaactcaaaagtgtgatttgcttgccagagaaggagtagaacaaaagttctgttaacatagcaaagaatccagcctaggataattgggccatgcttttcctttggcattggtcagtgtgtaagatcaaagagacaagaaggaattgatgaagagttcattctttttgtgatgtaagtattaaaaaacaacttgaactggtttaaacataaatggagactatattataactagatactccataaaaacctaaggagaaggaccactgcagtcaggactcaggaattagaatgcttccactgatacatattcatttgtctctctctctctctctctctctctctctctctctctctctctctctcagaaggggactttacctctctctttctctacatgggtatatggccaccctatgtcccctgaaattgtttataattctaccaccagccacaacagagcgatttattagctacctcttagttataatttctagaggaaaattcgaattgactcagttttgtttggttggttacctctgagccaattcattgtggccaggggtgtcacgtacttataaaatgagtatagcttttagggaccatttcatcaggtagaagcaaggtggtaagtatcccagaagacaggaagattatggagacctgggcagacagcctaaatgacagatacagcacattcactctttttaccttcaggttaatcctttcaaatttgcaatcaattaactttttgatatcctaagatgagatgtttttttctcttttagtgtttatcaatatctctaattttggcaacaaagtcctttgtctcctacacagtcaaataaccatgatttatacatccttctttctaagtaaaccaaaacaagctaatagatcaaatgttatatccttttgagtaattatcaattgttaaaatttactgttccagtctaactttaattgtatgtataatacaagtcacatgttttaaacaatttttctgattttggaaaaactctgaaatcatagttacaaacatttgttccctttggtccttccaatgaaagacccaatccatcatctcaatactttgtacacctaccagatatctaaatgatgaactaaaattgttagaaaacctttgtttttctggttgttttgcatatcattgcagaaaaagccatggataatttaatctacaccatgcataagactgtctcatttgttcccttcctaggatgaagaaatactgacttcattgctctttcctttatctttgtggctctcattgtggtgatctctttgttcccaactctaagcccttttctcccacccaaatctatggctctttcctgtctaccctatatagtattggcagaataattcccctaaagcacttaattcgttatgtcattctcctgtagggttaccaaaaatgggttttattttgcttatcatttgagtccaatctgggcaaacctttatgagtttttatcttccagtcgcagtctagacacctagctttgcttcctgatattccctttctcccatcttcttcagtcactgcagccacttcactggagctacacatgtcacatgcagagccgatttcaatctacctgatgctttggttcattctcctttcccgacatggaatgcagtataatcctccttttcaatgttagttggcatcctctgactagttttactactcaacatactgcctaaaattctccatcactcagtgaacaacaaagttgacatgagcatcagtgttttaagaggtggtttaactcaaacctatagaaaacttgaaaataaggtgtttttgaaaatgtgctcaagcttctattgtcttcatgttcaatttattatatgaccttgaagagaggtttatgttcaagaaataataatacagatctcattgtaattaccccataattatgcttcttttttctgaagaccatatggacctataaatgaagtcaatgagttaagagtagggagcattaaacatggtgaaaatatttttatttactgaaaaaattcaacagcgtattgtaaaatatttagtagaaaatgtaccagactgagaaaacatatttggagctccatttcttcagcttactgactctctaaaggcattcccctgtccttctctacagggaacttccatattttcttccaactgtccatttctagccaggggtaagcagatttatctttaagctgttacctgagtggagcctgtatcagttctactcatatcctattgatcagagctgctttgtatatccatacctcactgcaaaagaggctggcaaatagatgctctatctgaatatcaaggtatatatttaaaacttggggcctcttttattataaggagtaagaaagagattgatccttgaagacagccttggctatactaggaatgtcctacacctaaaaaaattagctggcagaacattagtcaacttccgaatagatgcttttaatgaccatgagttttgtacttttattgatagatcccattattatcattttttaaaaaaatcagccaaagttaatgaaggcctcttgagtcctgaggaaatatatgcacaaaatcccttcttgggatcttcgactgtttcttacatgctttgccttatagactcactgctattctagtcactcttccttccaaggacatgctacagtttatagtggccctgctgagttattgacccaggatattaacctggttatgaaaagctagaatgatcaagctacagatttggattattatattttgttgaacagtgcagttattttcatatagataaacatttctcttactgagaaatcattttcttctgggtactgttgagttcttaatttaatcagagaacattttatgtgtagtagcaaacggtactttcagtgagcttaaattttgatggggaaactgacagaataatttgcaaataaatatatgatatgaatttaaatagtgatgatttttggatctgtggctctactcaattatgtttctttcttgctaagagtttaagatattatcgaggttaccaaatagactatttatttagcacttttatatcagtgtttagtttccagaaaggtgaactgggtagccatgtttatattgtacaagtgaagtcacattgatattttattgcaatggaaacagtaagtggtttaaaaggaggaatggtgaagtgaaagaaattatcaacctgtttctttttatattattatctaaaactagtcatttttctgtttttctcttttgcattttttctcatttaagatcataagtgcctgttttaaaaagcagcccaatgagatgaccttgttaaaactcctgattatttctcagtatcgtcaattaaatgaaccccttattgtgtgcccacaatgtacaaggaattatatatacatatatatatattttttttttctttttttttcttttgagatggagtctagctctgtcgcccaggctagagggctagagttcagtggcgcagtctcggctcactgccagctctgcctcccaggttcatgtcattctcctgcctcagcctcccgagcagctgggactacaggcctggctaattttttgtattttttttttttttaaagcagagatggggtttcaccgtgttagccaggatggtctcgatctcctgacttcgtgatctgcctgcctaggcctcccaaagtgaggaattatattattattgtagttatgcaagttgaataaggtaatccttgccctcaagatattgaaactttaacaagggaaataagacatttgcacaagtaaataaaatacgataatactttaaatgtgatcattgtttttcagtattagtgttgatgcccattctacatcttcctctaaagaaaagaagacaatttgcaataaacctttggaaaggagttttgttgcgtctgtacttaggcaaatcgtgactaagaagttattctcctaatggccgcacatggtggctcatgcctgtaaccccagcactgagaggctgaggcgggtggatcacctgaggtcaagagtttgagaccagcctgagcaacatggtgaaactccatctctactaaagatacaaaattagctgggcatggtggcacatgcctgtaatcccagctacttgggagactgaggcaggagaatcgcttgaacctgggaggcacagattgcagtgagcagagatggcgccattgcactcctgcctgggcaacaagagccaaactccgtctcaaaaaaaaaaaaacaaaaagacaaatatataccagataaagtcctccaaaaaaagagccaggaaaagagaaaggagaccaggagggggttgcatgaagaaaatttagtattattatccagtattgccattgtttaacataatttgagttttaatcaaaatttacatttgcataatttaaaaaaccaaataaaatgtaaagagccctgccttatcattttcctaggaatttccgtgcttagagaaaacaccttcaactcctttagatgtttattctgggctttcatgtctgtaattctgggttttacatatatttcaccttgatttttaaaatgtagatattatctattgtcttcctcctatagaagatgaatgtttagctcctttcacctcctgcttagcaatccctttatttggttaaatcagtattcagagatttctttattatgactatataaatttactgtacagctatgccatataatatgatttgactatattttctttgctcaaaaaatttgtcttccttagtttttcaggactctctttggcatttctaggaaacaaaactctccaagggaactctgttcaagaaatctatcaggttttgttttttcccactagatatatgagtgggaagttcaggctggttgatctttagttctgttgcacagctatatccaagggctaacatttgctgctatactagggatttccttcccctgtctcctatgttggatcctccatttcctgaatcctacacgttctctcttcttggtttatttgtgtatttggtagagcacatgttctagtagcttctgaaaaagaatacaaggagggaagtaatttgaggagaaaattttgaatatctgaagtgtctttattgtctacaagtgtctaaacataaagaacgatttgaaattttactattatatgaaaacttttcattaaaaaaatttaaatggttgtaccattagctgttagcaatgttaatcagattctttcttcttttctacttttttttttttttttaacgacctggaagtttttaccatctctatatccctgggcactcagtggacccttttgcctatcagtgatggttcttatgttctgagaaaatctgcaaacacattcatagcaacatctagactcatgttcgaccaaacagttggacaccaagcctagccaagttgatgcataaaatcaacaatcacaagcaacctttcacataatgcctgtttacatacttgttgagtccagactttctttagtttaacttctaaaggaaaagcttactgcatcttcctgaagtgtaagagggacaacttcctggttggggaaggtatttagcacaccttatatctgacttcggaaatctctggggctttcaattccaaacctttctgtctagagttacacaacttgaataaattagcttattgtcgggctctccactgcaagagcttagctttttcttataggtatctataattgattgtcatttttctccttctctcttttttttttttttttttttgtttatttcatctctggggatttcaggagggaaacattattcaatctaccatgttttactgacaatgttcccctagtgtttttgaggttttaatcttttcagaccaaatctttgcagacatccttgagccctctcttttccccacaacctttgtctcatctaataaaaccaattctgctgattttaccttcaagtatatccagaatttgaccacttcttgccacccttacttacaccagccaggtccaagccaccttcctctgttcctggactattcaagtagcctcctactcccctttatctttcttccatcacttctcaacagacagccaaagtgatgctgttcaaacttgagtaacatcccatcactccaccttccatttgcttttcaccatagctaataagaaacaaagttgatattctttaataatcctcatggtctataatgtccatgaactctctgacctcatttccacaagtcttcagatcatttcttcctctccagccaacaagcctcattgctgtccttcacaactgttcaatgctctatctcaggcaggtataaaagtacctccatagcagtgctccctatatattttctgaattaatggataattatatttcaaaaatacctcagtggcattctcctgtttttaggtgtgagcctagcaaaggtctgtggtgtttttttcacaacacttacgaaaagcgttgtgttcaaccttgcaaatgaggaaaaataacagtgacctaagtatcatatattttttaacaaaacaagatatagtctgcacatattcatagcccacgaaaagagcaatgtgtgctttggggtggacatttttttattttttattttttattttttttgttttgcttcagaaattccactttaatgtttttttttttcctggttttatggtctcttacagtaaaacttgcattgaaaagagaaacccttatcctgaagtatctttatcataaacagatgtttgcagtagccagccctgcaatgtgcacagtaaaatgtgctgctacaatctgaagctttcatttacttatttaaacatgtctgagagacctagatcatataccacaggggcagacagcatgctggtgtgtgagcagtggggcatggagggagaaggatggggtaggaagggatgagtagcaagcttaaggacttctgcctccctttcatctgtgattgcaaatactgctgacccatagtagatgactgcacatagattcttgtcccactttcctaaaaaacattattaaggaaggtgcatgtaatgaaacctcatgtattattaacctaaccttactacgaatgtacaaggaataggtttaattcaagtaaaatttataggcaatttgttaaagcagcagtgcacattagaaggtacattagagacacattggttttaatatgccattcaataacttgaacagaggttaaaaatgctgcttaacctccattaagtattttaaaaatgctttaatttaaaattatttggagtgtgtgtacatatatgaatgtacacatatccacactaataaatataacactaaatatgttttcccagttccctttttcagtgctggatgaccttataatgttcagcagtaggcacttaatcagaggccaggccgaggaaggcagggaaggatgtcaacgcatcccgagccagtgacccacccttgtccttgagaactagaggcagagagtgcatattgaagactctgtagctttggaataaaacaaaggctaatttataatgaaaacagcttcctatgacatgttttgtactaatagggcagtgcctcctgcttccccctagtatttacttttggttttcttttacaattcataaaacaaagtatcttgtttcattaagtagcacatcatatttattaagtaatgagctcataaactagaattgtgtacaagaccctgccaatggaattggaatcagatgctgatgttccattaaaaatcaatgcatcaaagttgatatccaattatgccacatttcctagtgtttggtgagacaactttctaggttaacatgtttttcacagagagacctgaatctaaaagtaagaacctcttccttgataaatcatcaggaaggaatcttgtcacaggaaatacagaccacaatcttaggtacatctggaaaacaaaaaaaagtaaaagacactgataagaaaaatttctctgtcatagaaaacttgctaattgacaattacaaagatgataatagataatgtttactgagagtccgctgtgtgccaggctctgtgataaggttttgcctgcaaactttcatttaatatgcacaatatttctaagatggaggtgctgggattattctcattttaatctaattgggggaatgaaatctaattaagtagaagagccatttataagtccaggtccatctgactccagaatgtatactctgaaagagtggaactttttctttttctttcttttttttttttttttttttaagacggagtcttgctctgtcgcccaggctggagtgcagtggcacgatctcagctcactgcaagctaagagtggaactttttctaaataactaactcaatatttatcttacacattcacacaacaaatatttgagggtgagttagataaatactgtttatttcatccactttcaagcatacctcaactcatgattctggcttactgcttcacattctgggatacctcatttgttgttcaaaacccaagtagtaggcataaaatgaaaattaacagagtcctgggaaaccacagagttcaaataatgatgaggtaaattgaaggggtctagaaatggaattatctccgagaacttagttggagaaattctggagatggttggaatggcacaggagacaggctttagagcatgcatttgataaacactgaatgggaacagagaatataagttttgctgtggattttgaatatgcatacacatacatatattaattataatctccaagatgtaatcagagttgtcattatttgggttatttgttgttattggatttgattcttagagaatatgttaatgagggcctttcatgggtattcacataaatagaaaaattggattatttatgaaacagaaaattccaataatgttttcccttacatgagcatattattatgtcctttgtttaagagctaagatatagttttagggtgacattttctttctgcagctctgttccatctgttgctgtgacgagcactatattttaaatttattgtgtctgatccatatacactcctctctagactccctgataggacaggccactctgaccaaccactctcatgactcacagatttatgtttaccattttccttttcagtgttaaagggatcatctcatattttagaggatagaagatatttatccatctatccacccattcatccattcagctatctatccatttcattcatacatctgtttttcaataaacatctattgagtaaattaccagagactatgttggtgttaaggtatacaatcacaaatatactaagacattgtgatttagtaggggaaactgactcacatgtaaatgtatcacaatgtgatgagagccatattagaaatatacaatatagagaagtagtaaagtgaaggaaatgattaattcttgaaggatgaggggtcttaggaacttagagaaaatgatttctgaactgacttttaaaaggaaataggaatcagcaagctgctcaagaagggagtagcagcccagaaaaaaaaaataacagcagaacatttaaagcatacctaatttaattgaaaaacccttaaaaattgttttaaaaaagagaaattataccttgggatgaataatattaatatttatgtattcacttgatcaagtctagaagtaattttagcgtgattttatataaaactaccaaatggaggaaaattattattgttttaatttgaaaactaccatcatcaactatactgaaatatagtttacaaacaatacaacaatattgaaaatattgattcataaagccattaccaagatagtcttttgttgcatggatataggtgagccacccatccctccccaggctcttgtgtaactattatgtccattttctgccttaaggtgagagtagtttcttctaaatgtcttacaattagtgcttagccccagcattgccctcctttcttgaataaagcctagaggttacacttcttttctttctccctctcaagaccttggcaaagcctagttgttcatggtcctcaggagagacattgctgggaaatgggctcttcttttatgcccaggacaagtactgtgctatgcaaatagccgctgcaggagataataccagctgccttgctaataactttgaactctgtagattcttctcctaggcaaagccacactattttacaatatgggtgactctttgttttagctggatgatacatttttttccacttgagatttgtcatgtctaaaaccaagggtcagctaaataatatgggaaaataataaactagcgagctgatttggaccatgtatatgtgaactctcagcactacgtaatgcaaggtaataatgttgtcctaatgaccatgcttaagaatgtggtacaaaatcattcatggaatgaaatctcaatatgatcagttacaatgctacagatatataaagatttggaacatgaagaagagctaacaaaggggtatcagaaatgcattacattaaagtaaattgaggtcagttataattaagccacattcaggagttgatgtttaagtggaagggaagggaaaagattgttttctatagttggaagtcataaaaggaggtaatggtctagaattaggcacattcaggtaaggcaagaggtaatctttaagcaggaagttacctgagtcatcctaattagaactgcttaaaaataggacagctaaaatactggtgggattaacctttataatcaggctcctgagaggaggaggggaattaaccccaaggcaaattcccatgcagtcttttcctggaagccctaccttcactttcagtctccctaggtgctttagcatctttttagttcttctctgcttgtacttctgatttttctgtgacattctttattccccaaaacttggactacccaacttctgcaccaaaatgctatcccctacttgtacttacaggtttatctaatacatcatttcttctaaaaatcacccttaatttttccaaattctctgtggcttggagctattgcagtaagtctaaattaattctacttgtaagtatctgtgctaatgggtaatttatccaaattggagagctgttagcacattcatgatgccatcatcatggatttaagggcctagataccttcacaggaagaaaaatacaaagaatcacaaccacagtggccttgaatttaaatggaagccttctgaatttgactttgatcatgtgatgaatcaggtacaagaatatatactaattgtcatggccatgctctatttctggatatgtatatataagggaaattgctgtcaggtggtacaaataaacaaatagcgtaacctggctgtaaattatgataaaaatgatagtattagttgatttccgccaactgaatggcacatattttgagctctttcttttcctctcattgagcacaatgttttctattttgctgcccttgaaactttgtaagacagaatgtataggatctaggggaaggaaaaaaacccaattgttggtaactataagaaaatggcttgttttcaacaagagcctggaatgagttttagagtatcctaattactttttgctgttccctatataatagataagagaatagattcactttttgctcatgctctccttctttcaatatcattgctattttatgaactttaaattagtgtcatgacaattgtacaattcatttttatttgctgtaactgtattcattagaatccttctgtgatccttctaccccattgtttcagtaaaattctttgcagcattttgcacgggcttgtgtgtgtacccatgggtctgtgcatgtgtgtatatgtatatgtacacatacatgaacacacacatcacacaacactaagaaccatttctccctcatatgcctgctccacattcaactgcctgataactttctaattctataacagttaacttccatctcctgggtctgaagagattttaagtaatttgaataaacttttgaatcatatttgtatttctttcctttttccataagaaaaaaaatatgagttttagaggtaagctaaagtctctaaattctgcaggctttttttgtgtgtgtactacttgcagggctcacagcctgtttaataattgaactcatttttatttgttcatcgaatgtgtttggaatgcctactatgtgccaagcagtgtactggctgctagggagacaatgatgaatgaagcagatgggttttctgcccttatggaagttagattttggtggaaatgagattgattataattttcatgaacacttaggaaacaaacaggatgctatgcatttgtaacaggtatacctagcctggcctagggaaagttgcctgaggaagtcacgagacctgacttacatgagtgaactgagcaacagagataggtcaaaatcatcccagcagacagaacggcccatgaaaaggcctttaggtctcaagaagaggaacaaatatgactgcaatggactgagcggggggatgagccatgagctaaagctagagacgtagctgggacctgactgtaggattgaaagctgagtgagagatttggatttatttcctaaagggaataggaagtcatcagttagtttcaaatagagaagtgaaatgtccaaactgcactttggaaaaagactgctacgaagaatagattggaacaggacaagagggatgcaattagaagagatggcctccgggactgggtggtctgggtgtaaacctgggttttgctatccattaactctaccattttaggaaagtgtgttaaccttctcaatcttctgttttccaattgacagaatagatgtaataataattcatgcattatttgcatttctatgacaactaaatgagatgctcaagataaagcccctacagtagcatctagtttgaagtattagttataaaaaaagtggttggtgactttatctgggaggtcgtagcggggatgaagagtggaaggtttaaaattgttaggaggcaacatccataggacttggtaattagcaaaatatagggggtcagagaagtggaggatgcaagcttttgttttagtaaaatacagaattagtttaatttgaatttcagataactttttttagtctgagcaaatgctgcatgggctgcacctttgctaaaaaatttcattatttgttagaaattcaaatgtaactggcttcctatattttataagtctgccctaccaaaggtacctcagtgttctaggcaaagcaactgaatgactggtaatatctgttggaatggagctgattagaggaggtcaagttttttgtagaaatattgaaatattgcatggtagattttaaatacattgaattgtaggacctgggaggcacccaagtccaatgtagataatttactcagtttttctttggtcataattgacacactgaaggacagatataaccacatttgtattgggaattagtgccttggtagagtattctgtttttctgtgtaatcaattattatgctttaaataaaagagtggataaaaagtatatataaaacttttaatttctttatttctaggtttttatatttctccaggcaatgccactggctgcctgccatgctcatgccatacaactggtgcagttaatcacatctgtaatagcctgactggtcagtgtgtttgccaagatgcttccattgctgggcaacgttgtgaccaatgcaaagaccattactttggatttgatcctcagactggaaggtacatctttataagctttaataatttaactctttctttagcaacagttaactttttttggcagttgcaaagcaataacttctgtaaaaagtattttttttgcccggcttggtggctcacacctgtaatcccagcactttgagagaccaaggcaggcggatcacgaggtccgaggtcaagaggtcgatatcatcctggccaacacggtgaaaccccgtctttactaaaactacaaaaattagctgggcaaggtggcatgcacctgtagtcccaactactcagaagtctgaggcagaagaatcgcttgaaccgggaggggtaggttgcagtgagccgagatcgcgccactgtactccagcctgggagacagggcaagactctgtctcaaaaaaaaaaaagtgtttttttgttattgatatgttttttgttccgtgacatccacatttacttaatgtatgctaatctttgaatatttcctagagtgggttgctatatattgatagatgtggcccatcctagcatctgggaatgttgaatgagataaaatatattttctctcaaaaagctgagagtctggatgtggagaaagacaggaaaagacatatctgaagaagaaaatacacatactcatactttctctctctctctctctctctctctgtctctctgtgtatatatattatatatatatattatatatataatatatatatatatatgggatatatgtatgtgctttgttcttcattgcccttgaatttattgcatatttattagttcattgcatctatttatattttccttgcgtttctaatttagctttaaagactggcagatgagaaacatagctttgtattctgtgatatgatttttttcagtatgtaaagtatattatgaaagtaaatcatttttcaaagttacactctctttaatattctacttcttattctctgggtatctgtggccatttgccttcactcatttgtgtttattgctgtatttttgaagatgtgctataatgccaattctgtgtctgtgtgtgtgtgtgtgtgtgagagagagagagagagagagagtgagattatgagcttgtctaaagttcagactaaatctatgaattctttgaagctcctatccctgagaagctagtagtgtgtgctgaactcagaaagcatgtaataaaatgagtcaaatctgtctctcaatatgtgtatatttataaatctaattgctaattatttcagggtttgtgattatctgggctcttttaaactcattgcccccctgctgcctgccttttggctgttccactcctcattaacacctccattagagggtggacaggtgacagggtaattactgaaaaagaacttaaactagttcattttgactttcttttaaaatttgatgtgatttttaaaaactacaaaaatcatttaaaattttattaaaataatttttgttttcttgacatacatgcatatattttaatctgtgacgctctacttctatcaccgtagaaatgttaccttgatggtctgagaccattgtgactcttttctacagatgttattataaatcatctaaatgagtatacaaagcgcatggtacagtaaatagtaaataaaaagcactgtcaggattttgatagtaaaataggagccagttactgcacatactagctcctagatgtaatttttttgaaataatattctacagattccccagttggaactcttgggctggtttgtttcactcctggccacctctgtctttttcatagttctgaccacatttaccaggagaaaaatatcttccccaacccactgtcctccttgcaacactcattcccatcagtgccattttgtgacattcaattacccatttttgttctactcatcccctttgtcagtcttcccagggttatcagcaaaacgcctgctcagtgacctggggatgtctgattgtctcagctttttcacttaactttttttctttaagtgagatctgattcccttcattacactgcttcctctaccctacaatgttcttaaattcgtggctgagccttttaccccattctgttcctctcccattatctacccatctcactctcactccccaccttactttagtccaggaacaagaattgcttaataagtactgttccatcacctgtcactctgcagtaggcctgactagcactggagctagattccctgggttagaaggtggatttaaatgtttacataaattgataaggaataggaaggaccaaagaagtgggtataagctacatttttagaagataccgaagttacaataaagaaagaattcagtctaggcactatggctaactcatgtaatcccagcactttgggaggctaaggtgaccagatcccttgagtccaggagtttaagaccagcctgggcaacatggcaaaaccccatctctgtaaaaaataaaaagttagccaggtgtagtggctcttgcctgtagtcccagctacttgggaggctgatgtgggaggactgcttgagactggaaggtcgaggctgcagtgagtcaagattgtgccactgcactccagcctgggcaacagagcgagaccctgtctcagaaaaaaaaaagcaaaaaagagagagagaaagcagacttcagattcgcaaaaagaatgaggggcaggttggagtctagaaaatagagctaaagtatgagaagctgagtagatttctaaaaatatgaatgattcagattaagtgtggggttttttttttggacagagtctcacactctgtcgcctaggctggagtgcagtggcgtgatctcggctcacttcaacctctgcctcccaggttcaaaagattctcctgcctcagcctcctgagtagctgggattacaggtgcatgccaccatgcctggctaatttttttgtatttttagtggagacagggtttcaccatgttggtcaggctggtcttagactcctgaactcgtgatccgcccacctcggcctcccaaagtgctgggattacaggcttgagccgagtgtgtgttttaaacaaaaagatccacaagttttatataaatgagtttggatatctttacatattagttggctcctgttatattgatgggggtggtgagattacctttttaaaattacaaattgtccttggaaatggtcgcacttttcttccatccctgtattagtccgttttcatgctgctgataaagacatacctgagactgggcaatttacaaaagaaagaagtttacgggacttacaattccacatggcttgggagacctcacaattgcagtggaaggtgaaagacacgtctcacatggtggcagagagaagaaagcttgtgcagggaaactcccctttttaaaaccatcagatatcgtgagacttatttactctcatgagaacagcaggggaaagaccctaccccataattcaatcacctctcactgtgttactcccacaacacatgggaattgtgggagttacaattcaagatgagatttgggtggggacacagccaaaccatatcaatcccctttgttcttatctttccagttccaggttttccttttcagagggattctatttttctcccttttctaactcctgccattattttaaactactttgacatgtactgatgcagttctttggcctcttcattcattccccactccagcaacccatttccatggctacaccctggattttgtgatcacttataatttctctatttctcaaatcttcctaatcccatgaatgctattctatggatatatcacatctttccaattccaattcaccctggaagcctcacataacctgctccttaacttctcttaatctttatcccattatccctccttaatcctcttttgatcaaccccatccctaacttcactgtcttctacttctagcctgaggcaaaacctttttaattatgacccttttgagtacctgattgtgggctcccttctgctgtactgtggggtcagctccagagacgatcaccctacacctgccctgatctgtgaggacgtggggaaagatcatgtgcctatgctgatctgaagcactaccatgtatgtacttcttatcaatttactttctttccccctttaaactcctaccagtctcctcagttttaattccatgctcttgcccttgcagataatctggccctctgctcatagacaaaataaagccagatatatgtatctccagattatcttttctccacctccagcttgtctacattgtcacacatttttaattttttatctagtcttagaagaaaatcctgtgtatttttgcctaaaaataacctgttcccagtccttgatatgatcccttcctgttttcctactcttgttcctccattccatgatctttgctccatcaaatcctccctttattttaactcaaacatctctctataggtaatatcataactgcctacaaaaatgctattcattctacaaactccttcctttgattctgccctgctttatgagccctgaaagttattgtctaatctctcactcttcattcacttactaacatttaaaaagagcactatgattcaagaaaacatgatttaaaaaataaaagatcagattttttttcttcttcattttgtttctttctcattcattctttattcaccatgtgtggtacatacatgttagcagaacatacaagttagcagaacttgcaacatgcagacattcaagaactagttatgtgactattaaattctcatccaaatcaaagacaaggtctataaagagatataataaacaaaaatgggttaaggaaaagacagaatgagggaacaggtttcactggtgggaaaaagggaggggtcagtggtgctttccacttgagtccagtgagaaggtcttatttgatcccttgaagggtgacatgtgtctcctgcagttggagagaccagtgcattgatatctatcttagacctggcaaatctaactgagaagagacagtctacccaggtttggataggtaagctagaagacagtgccctgcatatcttagactcccagagttcatcatgacaaggaagactacgtatttctcatgaccggatgaagaccacaaggaagaaagacagggtaaggttgtcttagtctgtgctcaaagtaccacttagaagataaaggggcctgtgtagaataaaggacaagattactgtggactacaggttaataagcaaccagtcgaaaagaaaatgcatctgactgcactaaaacaaaaggtgagagatacctaatggtgagaaagatcaatgaagaagtcaggaatgtaccactgtcagtgataagtcagttttatgtatatgcaggaccagagacaatagactgctttgggtggttctagtccaagtgagtttctacccttcctgcagcctctacgtgagggaggaggctaaccaagctaccttctctgattatagacttgctgcctttatcatgtcctagcttgatgaaaggaagagaagtatgttcttgaaaatgtctgttctttaaataaagattggaatgttgactaatatacaggattagactttctattttctgaattgaatttgtattttgcaatgtaaagtaactgtaggacattctattgcctgagaaagaccagaaaagccaagtgactaactcattttatatccacatggaacatgggggaattagctccatattatatgtttaaagggtcagtgaaagacaaaaataaaactgatttatgattgcttctcatgacttatggtttctcaatgtgctggtcatttcattgttcccatttatttcttaaaattacctcttcctttggtttccaagattctacttctcttatttgttttctaactctttttttggctactcctttttaatatgtcctttcaatttccacaactgtgtccctgatttcaaccactacatacatgttaatggctttcaaacacatgatcacccattcagatgcctgccacgcactctaggcctgtagccagctgtctctctgagttttacgcttgcaagtccctcgtgcatttcatttttaatatagtcagcacagaactaaccattacttcctcatctccacccaaataaaaataagtcttatgccatctcatgctatcatcatcttggtgaaaaagacgtaaaacttcaaataattattcaagtccaaacttcccaagtttgagtggggcttagattcttctcaggtttggcagaattggctctgttgttgagtagaatgagtctacaggctactgctggaaagtgctatggaaagcaagagctactgtatataatgcagcttctctaaaaagaatagaaagaataaagcttcccatggccatatgggacccaaggagatcagcaggatttgtctcttactaaatcagtcgtgtggaatgctggtaacttgacttgaccctcctatcccactgatgaattcagctgtctcttttcacttcaacattgataatcattacacaggaaatcctgtagcacagaagggcatggagaaggatattttaaaatgtgacaatgagaattgcttgagtttggacttttgttcaacattgaaaagagataaaagtgggttctttttaatgtttttccattcctcttttgaatgataccgttcttgaatctttttttgacttctggttgttattgtatatacaccaacattggctatattgaaaatgtgtaacaattgactaagatatatgggattccatcaagtataagaaatttttgttttttaaaggaaaaaattcacatgtaatgtaaatatatacagatatgcagtataggaaaacagctatgtcctaatgttaaaacaatgtttttgaaaacaaagtagattcaaaatcatttgaatctactttgaaatctaggcactgtggtaggttattacaaatagaaatgtttacatttataaaaattacattccaattataacaaatggaaattaaaacattaattttcaaaatatacagtagattataagtaacttattattatgaaaggggaagatacaagtatcatattatttcttcatcaacttggaaaataacctcacttccttatctgcctggttcacatattccttaccttcttcatgctctatttgttggatatagcaaggtttgctatattgttttctcttggtttatttgctacacagttttttgtattcccaagggcaaaataaataaaataaaatagacctcggccctaaactacacaaccaacaacaaaaatccaggcaacacaacaatgactttttgtgaccaagctggaaaatcatttgcctgtttccatctaagtggtttattcttcaaaagttactgaccagaaaaagggggcatgtattttaaaaagctgatcctagtgcaaacattactccatttacctctgacacataaagcaaacatgatttaatcagtatcgaaaacaatgaagcaaaaaaaatctgcccactgaaaaatcaataatgcaaaaaagtatatagtgtttgtctaacccaaaaacaatgagacaaaaatgggccatatttaattcatctcagttggtagtggagacccatatttgacaccctgcacttactggcactgtcctcaagttgacctgtgactatgactactctcccccatagcccccaggactgctccagttcatctggtaccccacagttttcttacataacaaccacacatcacaacccccaaaagtttcttccctaatgatataccctctctatattctatgttaccttgttttaagccttaaggagttagtggtatcactatttgtcccatttactagctgacacacactgaagttgtccatagagggtaggacaccaaggctggttagggagaataaaggctcagacttctggagcataaaatacagggaagttcttctatgcccagattatttttggttttactgcaaatgttctacatttcagcactaggttatagatttggtccagtaatcttttcacaggcctttatccgattgatctcaattggtcttttctctgagaaccaggtcaatgacttcagatgaaagcagataacttccttgtcaactgatttccttttatggtgtgataatggaaaaattagggagtgtgcctcatagattccctctcctcagtgactctttgtcagacagctggctgtcatctggggtgacagggtaaatgggccacaagcctgtcatcatctggcagccaaggcagggctttctcacaaggcagtggcagatttccaagaaagaaagcagaagcatgcaaagacacttgaggcccgaaccgtcaggatgttacttttaccttattctactggccaaagcaaggcacgaggcttaaccatgtttggaagtggtggggaataaacagactctccttttgatgagtagaactaattatacagttagctgcaaaggacctgcacagagggaaaggtgaagagttgtgatttttgcaatctcctatggctgccaaactatatattctctcttagtatagatgatatatgatctgataagaagtatcagtttttatatattagtagcatttattcaacgtgatgtaataggaataacatgcaactggacatcaggatatccaggtttcagttttgtcttttccactagaccagatacagtagcttcctattattggtggaataaattatctcaaactcagtggcttaaaacaacatgaatttttattatcttatagttctggaaatcagaggctctaaatgagtttcactaggctaaaatcaggcctgtgtttcttatggagattctaggaaaaaaaaaaacatttccttgattttcccagcttttagaggcaacctacaatctttttttttttttttttttctgagatggagttttgctcttgttgcccaggctggagtgcaatggtgcaatctcggctcaccacaacctccgcctcctgggttcaaatgattctcctgcctcagcctcccgagtagctgtgattacaagcatgcagcaccacccccagctaattttgtatttttaatagagacagggtttctccatgttggtcaggctggtttcaaactcccaacctcaggtgatctgcccgccttggcctcccaaagtgctgggattacaggcgtgagccaccgcacccatcgtacattctttagctcatggctccttccttcattttcaaagccagcagagcagtgtttccttggacctctgcttatgtccttacatgttttctctctgactcttaccctcctgccttcctttataaggaccgtagattacattgggcattcttggataatccaggataatctccccatctcaaaatccttaaccacatctgcaaaattccttttaccaagtaaggtaacattcacaagtttggaggattagaacttggatattgttggcgtgggcataatatgacctgctctaccagagttcagcaatctatagcctgggggtcagccacatgtttatgtaaatagagttttattagagcacaccaatgttaattctttacatattttctgtggttgctttcctgctacagcagcagagttgagttacaatagagctcatatggcctgcaaagcctaaaatatttactatctcatcctttatagataaagattgctgaccttgtaactagatttactgtcaccttggacaaattagtctcactaagcataatagaatcataactttatagactgggaaagaaccttaaaagtaattttggttaaactctaccctatacatttctctgcgtaaatcaccttttcagaaaaactggtgaatggccattcagcttctgctccaaaacatggaactaaaaggagctcactgtctcatgaagtagctcatgtttatttcaaacagctgtaattcttcaacaaatagaaatatattatttatattgaccaaaaagttgcagtcttttgactttcttgcctagtcttatttatgccttctgagaccatagagaataagtgaaatctctcttctatctgtgagcactttaaaaatttgattctgctatcatatctgaaagttatttagttatttgcataaatatgtggagtgtcaacaaaggagaaagagacagtgttctcagatcagaaccttgctgagcaagctgcctggacttagctgtcactattgcatggatgcaagggagtcactgcccctggtccagcttttatgagtttctctatttgtgcctgggaaattcaccaaagagggtggggttgcacactgttaacgtctccctttcagatgaggcactcgtatttccttgttcaataagccatgtaaatatggctttcagttcacacagcgtggatgcccaagcctcaaatccctctcctataattctgattccatctccaagagaattcagatgctgttagtagtctgtaactaaagcgaaactaagaagctcaatgaaaccacagctcctctgttaatcggggaaaaccaaactcctctagagggcactgtagcactcaccgaattctgtgaactgagaacactggtttaagagaatctgaacagataccagctcttaaagaaaactgtccattccctgggagtgaggttagccagggggacagagttaagccaataaaaaggggctcaaaagagctaacttgttactagagctacaaaccatgtttggattaatctccggtgtcctatcctaagtctaaagcttccctggtgctttattcactattaattcctgtatccgacaatatttactgaatccttactgtgtgctagcctttgtgttagggactgatggaaaaaactaagacaaaaacaaacaaaaaaactctgccgaatttctccaatttgccttgaagtctcattctcttttgtttattaataatccttatctaaaatcccttagcaattggagatctctttctccttcgttctttatgttgaatgatgtcttcatcatccccattagcaagttagaagaccgggagtaactttatacctatcctcccttctcttttcaattcggcctcccattctaccaattttacttaacatttctcaggtctatcctactcatttccattgctccttgccactgccccaaggtagcattatcttacttctgctcacctttccaggtttatctatcaccatttctcattatgaatttacatccaggagtactgaggtgcttgcaatttcataccctcttctgctttttcttttttttctctatttttgcccctccccgacttccctggcttatttctactcatcttttaacgttcagcccaagcatctcctccaagacttctacttaaaattacccttcccatcccttcttctgctaccagactagttaagttgccccttttctggacctttagagtctggatacatctttattaatgctgtttccgttttttcttgcatacgagattgtgagctccttgaggaccggggcaattctataagattcatctctacatccttgatgtttattccagtcctggaacatagctggccctcaatgaatgttatttatgtcaatcaatatttaaatcaatttgatagtacccatgagctgaggccccatagagaggaggggtgtacaaagagaaatgtcaataaattgacctatatatcttgggatatatctctgggcctcctacagcagttctccctcagatgatgaattttctgacaatgatgtgcattactgaaacatattcctttcattaatagttaggtttcaacagtaataattaggataaccatttctctcactgtttccacaactggaagaaattcctaagaaaggaaggtatatgaaatttgtgatgtaggagacagaggccaacttctttcccattgtaaccagcaaatactgagttatgtaagggtccaaagagaactatcatagcaaagtgctggcagagattagtgatgctttactcctgttttgtttaccataatgaactggtcaataaacatcacaaattgtttatctatataaatcttgacagattactctttatgaaatccatttagcaagcgaggttttcccataaggatgaaaaatgaagattttaaacagattgcgggagaagctctggctgtaccaagagagtcagtgtaataaaggtttctttatattaatattacaaaaaccatttatcctggcaaaatcaatattgcaattcatcttagtttggtgtttctctttctaagcttaaaatgtcttttcctttattatgtataattttgttttaataaatgtgaaatatatttcatttaggaggtactcttgaggagggataacttataaaatgacatcaaatttgtagcttatttgctaaagagtcttggaagtgtttaaaattatatttgagtggctgagaaatctaaaggaatcattttgcttaatccttaattacaaaattatccctgtgtcctttggggtaaaaacaaactacaattttcagaaaagtcttcgcttgtgaacttcatttaggaaaaattctctcttactgaagtcaagtgattataacaagtcagataagttgactataacaatggcttggataagagactataaaatcaagaatagacacatttaattgctcaaaacattgcgtgctttggctggaagaaaatagaactacatcaaggaacggaattatgttatacattggaagctattactctaaatgtactgtatgtaaaataagtgtgattgtctcatgagtgaatggtaataaaaactgaaatactcaagagacacttattcatgagtggtgcagttacacatacatatatacacacacacacacacacacatacattgagagaagcttttctcttattgtttatgctcactaatattatattaaaagcctataaacaatagactctacataatagcctataaagaaattaagagcaaatcaagtatttttgcatctataattccattttaattataatacataattttcttcagctctaaaacttaacctaaacaaaacatctatttgaaatggaattctgatgtaatgtgtatagataaaagacctaatatagttgtttgaagggggaaaatgtccttttatcatgaccataaaaacggcaaactacagtacagtggttttcaagaaaaactgtactttatttattcccaaggggatattagtccataaaacaaatttgcagcttatttggcagtcttagcttttatcagcctttttaagggtgttgaatgattacccaagagatcacactgtaaaaatggcagtggggaaaagtaactccatccgttcagcatctttattagaatatataggtgaatccatttgatgttgttttaaacgtaccacaaggagagtaccttttaaatggtgagtggtcttcttacatgtgctgttttgcttctctaatacctcatggcaccaacgttgcttatcctaattagtgccattggcataggctacatgtttgaataattcactgtgaagaaacaagttttagtttctatcatggcaaaatgccactactggtatttttacaagcaactttgggtccaagaaatttaagttgcactaaagttatcttactatatttatgtcattagcatcttttcataaatcagaataatgctgtattctccaaccattatggataactaagtttagttcataaaacagaaaatgaaatataacccatattaaggcatcaaaaatatttgaacctgtctttctcaagcaattttcttagtgaaatttagtcttcatcgaactaactatagaattttaagatttttagggagagcaatgatttacccctgattttctatttcgcaattggagagtcacttgaaaagataattttatgggtacctaatctaaatgtttagctgacaggaacactgcttttgtaaaagcaaaatttacagcattcttaattgaacaactggattcaaactaatccataagatatattgtgggatgtaaaaaagcaatataatatctttttttgctattaattagtttataaagagaaagctttatacgggttttaccaggaacagtagttttataaagatcttttctattttcctttattttatgttgattctttgtttgtttagctcaagcattcttttcaatatattggctaaaacaagccgtcttactctacaatgctattggtaggtgtaacttatactatgaattattaatcaaaacactattctctttgatggtttatttgccttgttttcagatgtcagccttgtaattgtcatctctcaggagccttgaatgaaacctgtcacttggtcacaggccagtgtttctgtaaacaatttgtcactggctcaaagtgtgatgcttgtgttcccagtgcaagccacttggatgtcaacaatctattgggttgcagcaaaagtaagtgaactctggttcagtgctggtgtgtgaagcagcatcatacaggggactgcatctcattgttttctttctccatttagaacccatcagaaaggcttagtacaatgtgaagaacgtaggtaagagatggaaaaaaatacactgaatgaaatatgtctgcttttccttgattagacaattggaaatggtaatataattatgttcatggtgggaaatttacaatagttttttggagtgaaatcaacaatgaggtgattaaagtcctaggttttcccagaccaagggtcttcccaggacacaagacttttaatggtaaaatcaggactatattggttaaaccaaaacagttggtcaccgacacaaagacatttccaggtaagttatttttttttgacaaataaagggtgaattcttgtttattatatgtttgatattcttccatcccccaaattttgtgggcagtattataccattagttgtttatcgatattgtaataattagtatcattcgtcacgcatattattcatcccataattcatgtttctttctactttaagtttcactcatttaaatatctctcacatttatatttttaattccttaaagcctaagattacatgtaagtatcttttgacttttcaacatcgcttttcagtaccttgaattgacctcacaaggtcacctgcagttctacaatttcataacatattgaccgttttcctatatttacttcaagatcatacatccttaccctttccagaatccctaagaaatgcctgctgggaacatgtggtaggagccctctacaacatattgtgctatgcatattctccttggggtgtcctgagactgtcatgagtcacaatgataggaaacgccacaagtcatgacagatcatcacaaaccagcatgcctggaactctgctatctacatttaaggggggagggagaaagataagtaatgggatattggactccacaacaactgtactagattttgaggtaatggaaagcaggatatagctagtgattaagaagacgtattcatattttgtacctgtgtagtttctcttcagcatcccgcatttcatcagtccctctggatttcagtataagtaaaactgtaggtatttatgcttcttttgggaaagaactgtcataattcctttcatgtataaatacagtctaaacataaatctggacttcattggccacttaattactatgtgtcatttattgattagcaatacaattgattgctttgtatgcaacaaaaattctagcatattccttttggatatgagttatggatcgtcatttataatggaattacaatacctaatcttagtgatttctgattggttctgccactaattttgtgacaatattggcacctgctctactttttgctacctattccttcttgcatttgagacatagtctgggaattatctctcaggcaaaactggatagtcatgtcactggaaagctagcctacaactcttagtagtggtagacatttaattttatgttttattaactggacattctttccaagtgtttctgatttgttagaatttttaaaaactctcacattcctaatgattcttccctggacatattccttttggttttttatctctttaaaattatgatatatcatactgagcacagttcttcaactcttgtggttgttgctgcttctgttttaggtttttatttaacaaaatttttgaaacactgtgtaaagttggaagctcagcatcagcagaggcaatttattagaaacaaatgagacaactttcctgccttcagaggaggtcaaaacatagctagagtgatggacactgataataggaggggagcagaaaaatgtaaatggtgggatgaggatgaagggtcccagccttctctcctgttccagcttgattttcacatggtacttgtgtttgatcctagcagaagccagccagaacaattggcttcacaaagatatgatgaaattgaaaggaatgtagtgctatctattgctgacacagtgaactacctctgactagtatttgtctctgtatccaacagatgtcaagaaatattttcatttaaaattaaaatttctcatggtaccccaccccctacacagtttgggaactgcaggattataaccctcattatatcttctaggggccactagcaataatttagtaatatcatctgtgatttttatttttggtgggctgtcagggtgggaatcctaggatgtaatttccaaaatgcaagaggattgaatgaaaataaagtagttagaccttttcttatagtaaatttcccttttgggtgattcacttctttcctttaaatattggtatcatgctttcaaaatgatagtcattcttcttgataggaagcaaaacaagaattaacataaattaaatagtcctattttctgtatgctttcctagcgaatgatattctagttagttcaaccatctatgaacctaactaaaattatacacatacacacacacacgtatacaattagccacttattgtttgatagtgtttgtcttcttgacactattctcattgttatttattcatctttatatccacattttttctttatctctccttgccagagagcctcttctagctctccttttattaacagctttattaaagtataatttacatattatatatttaacaattttaagtatatggtttgatggattttagtaaatttagacttgtgcaatcattactataatccaattgtagaacacttctgtcatttcaaaaagttcctttgtgcccatttccagtcaatcatgactcccacctctagccccaaacaactagttatagggtctttgatgagataattttgcctttcccatgagttttatataaatgaaattatacaacatttagactttttgcaatgtataggcttttgtatctagcttcatcttaacaaaatgtttttgaggttcagtcatattgttgcatgtctcagtagattcttttaattgctgagtagtattttatggatacactatattttgtttatccattgatcagttgacatttagattgttttcagcattggtctactatgaataatgcatccatgaacatacagttacaagtctctgtgtggacatgcatctttatatctctttatatcctgagaataaaaaggctggtttgtataccaaatatatttttaatgttttaggaaactgccaaattattttccaacatggctgtattattttacatttacattagcaacttataagagatccagttactctatggtctcagcaacatttggcattgactctatttcattatagccattcagtgagtgtgtagtagtatcttgttgtgattttagtttgcatttttcctgctgactaatgttgaacaacttttcatgtgtattgtcattcatgtgatttttggcaaagtatctttgaaatattttgcccgtgttttagttgttagtcctcttactgagttaaagaattccttattaatttgggataaaacttgcaaatagtcctctcattctgtggatttgtttttcattttttttattggtatactttaaaaagcaaaagcttttacttttcatgaagtcaatttaccaagcttttcctttatgggtcatgtttttgtgtcctatctaagaaattttggattgactcaatgtgaaaaaaaaaaattctccatttttatcttacagttttatacttaaacatttacatttagatccatgaaataatttgaattagttttgtacatggtatgagttaagcatctaagttctttatttcatttttattttttgacacataggtatccaaatgttccattaacatttgttgaaattgccatcctttccccattgaattacccaagcatctatgcaaaaatgcagttgaccccatagctaacatcatattcaataatgaaagactgagatctaagatcagacataatacagaaatgcccacatattagccagagcaggtaatcaagaaaaagtaagtaaaagtctcccaaattagaaagttgattttctttacttgtagatgatatgattctatatgtggaaaatccaaacaaattcacaagaaagctactagagctagtaaacaaattcagcaatgttctatgttacaagatcaacacacaaaattagttgtgtttctataagccagcaatgaataatttgaaaaagaaattaataaagcaatttcacttataatgcatcaaaaatttaaccaaggagatgaagacttgtacattatctgttttctgtgtttccaggaaacctatagtataattgcgcaatgttatttctatgcactgttccttttatgcttagccatgtgctctccagtgtctcatgagtttcatgcaggatctgtgtgtgatcacttttctattaggatgctaagatagaagtaattttcccattagtatatattatctgtggtaataaatatattacttattgccaaataagccatttataattcttgggatgtaagaatcaaggatgccttccagcacactggagggtagaggaaataaaggtgatatttattgaacaattactttatacacatatacacacacacacacccctacatacatatgtgcatgcacacacacacacacacacacaaacacacacacaccttatcttcaaaataaccctgacggggagacattatcattctcttaatataaatgagaaaaggttcagagagtccaatcaatatttgactataatcatacaactaccaaagttccaaagctggagattcaagctggtggttcccaaagagatggatctagtcacaatattatactctcatcccataaaagagagtctggcatatgcaaagaccattcttggcaattttgatgagtgaatatgtgaacattttttaggaattctacttcaagcacataaaggttcaagttctctcatgctcaagatttaataatattattctcaaaagtgttggtaagtcatctaaaccttctggcttatgaaaatttcaacttaaataccaaagaggtactatttatttatgctgtggagtcagacaagattgtggttgacatggtcatagcaagtaatcagcttaaatgtttggaaagagcctctgtgtgtgaagaacttttgttgccaaggatattttcatgtaatgcaaatcattttctacaccctttgacatgggagtgaaacatctatctctctttcattttcattcatccccaaagcattttgctgccttagaaaatcatctgaaggtcagttttgattgctctaactctgaaatctgttgtgttcctgatagcatgcagagttttagatgaaatcactaatattcactaaaaaatgttaaattaccatgaattgcaaggttctttgagagtgctgtaaatgaggcagttgatgatatttgtggctccaccaagaacaacaggatttaaaaccctaaattaaaatccactgaaagggtcaaatgcattttcagtgttcaaccgatcaaagtgaccatatcaaatatggaaaattcatgaattcaaaaatgtaaggtgttattcggaaataattcttttctcatgtgtcattatgagattgttgctactcttttcctatgtctaaataggcatatagactgttggaatgttaatagaacaatgcaaattccaaagaagaaaaagacaaaaggagggcaatgagcatgtatctagtttgaatattttaaaacatatgatgtaaatattatctgccttaggatcagactttgtctttaggaagcctattcatagtacatggaattttatatattttacattcagtgctgtgcagaataaaacaacattttccccctctgttctcacaccaccatcaacatagttgaacaagcaattctgcagcattaatatcctacaatccagttcaactcttgcgctatatacctggaagtagtggcagattccacgggtgaggggtcagtccccaaggctgcccccaacttctaacaccaatcacaagctccaggttattttgcctgtgcttgtaacccactggctataaattggggctcctatgactccctccttgggttcaattactttggcagctcagctcaaaataaggaagcacttatttttactgatttatgatacaggatattgcaaagatacagatgaagcaatgcataggacaagatacgtggaaaggggagctgagcttccatgtcctccctaggtgtcacaccctccaggaacttccacgtgttaaactacatggagctctccctgtacccccaccaccccccaccaccccaaacaccctttttgttgttgttgttttagacagagtctcgctctgtcgccaggctggaatgcagtggcgatcttggctcactgcaacttccgactcccgggttcaaacgattcttccgcctgagcctgccgagtagctgggattacaggtgtgtgccaccatgcccagctaatttttgtatttttagtagagacggggtttcaccatgttggccaggatggtcttgatctcctgacctcgtgatccgcccgcctcgaccctttatagcaacttcattggataggcatgactgaagcatggatgtggcagactaccacaattactacttgagaccatcactacaacagttactactgttactatttgagactgtcattacaagactgaatgaaggaggatgaacgcagaaatgaaaacttaaaacaaaaataactattttacaggaagggtaacatggggaagaagaagaggggtccctgcttcttgtgagcaagggcagctgcctgagctgcttcagcccttcatatttattgggtagaaagagcagggaggaggagggcatgattggtcagctgcttgattgatcacagggtcatattattactaacaggcttcagatttgcctaataacaagaaacacttgtgcctgggtcatgactgccctcagcattccttccgggtgcagacgcagtttgtcagcttgccaacatcctgctttcatgagaacagtttgctgtttactcatatagcctccagtggtatacttagttgatcacgaccctcattcttttggccttcaacacatggacaactatgtagaaatgtgatttaaaaaaaaaaaggagtatgatttcatactaatcgactgagtggggaaaccctgcaaggctgcctattcagagtcttcttggcctctctctgcagtattcattcctccagggcatggggcaggactccttctaaaatgagggtctcatgacccacagtcagacaaggtaggtcagagaatttccttatggccggctctaagacagaaaggtggaggaacattagagtatatttttagtttccctggcctgccttggggagaaaaaggaacaggtagaagcagaacagaacagagacagaccctattttctgaggcctacttctgaagcctaaatctccccaatattgtaacaaaagactgtccttcacctgtatcactcttaaattgttctgaagctgcttcaggacccttggataaaagaccaatacttcaacaaaagataggcttattgtgttagtcaccaaggaaatagcaaaggctatggaagttatgagccaggaaccatggacaaaaacgtgtgtgtgtgtgtatggtgtataaatatcaaagtgctcttgaaatcctgtcttaaaatgtaataatttgattatattatatcttttagacagagttcatatattatatctattaaaaagagttcatcactcatgggtcctggtgaattagcaatagctctggggtggaagtctttgcttagtttgcagaataacttcactttactgttccctacttttccactttgctctgtcctccaagattctatgtggtttgcatcagcagcctccattgccctctggccatcagttagttgatttcagctgctaagagggacccaccaaacatctggagggcaggtggaaaaggaagtcaggatatttaattccccgctccctgtgtccatgtagaagcagcctcaagctaactgcatccctccatgagtggtcatagctcctgtcaggtgatgctcttcatacagtcatttctgtccctgagttctgtccccatttaagctagagatagtgtgcagagaagagttaacatagcaagcctgactgcttatttttagaaagacctgcttacaaagttggcctttggctgacatctggatccccactatccccagaactgataagagaggaccactgcacttaaacatttgtacaaagtacggtttatgcttaacacctgctttccttgtgggggtcttaaatttgggtaaatgccagatagaggctgctcataggaacagcccccaataaaaaccctgtgcactgagtttctaaggagcttccctgattggcaacacatcacacatattttcataatgcattgctgggggaattaggcccattctatctctactggaagagaattcttggaagcttgtgcttggtttcccctggacttcattgatatgccttttccctttgttgatgaattctgtaacatttcactgtaataaattttagccatgagtaggactatatgatgagtcctgagtcttcctagtgaatcattagacccagggttcagggttggcttgagaaaccctgacataaatagcaaaagagctctgcagttctgtacctgagagtactggaccatctcttttgcccacccttttgaaagtggttcctttattgagctctccccaagttactttttttgagtgtgctttcttttactgaggcttctagtgactgtagatatttcatataaaaatattaattatttgatggattcttttctgtaccttacatttacatatttcttaacaaaaagatgaatggtttaaaagtaaggtaacacagcaacctgtacccttgacatcttatttaaggagaatgtttgattaggttgtgcttctttaaatggatgggggattgtgcatcttgtttaaactagaaaatagtacgtaaactggtggttgattgtccctaaaaatatttagctgttgtttttctcctttatctttgcgtattctggtgaaaaaaaagaaaattcactctcaaaagcagggagactaagaaaaatttacagtgacagaacacaatgttttcatggtatatatttatattatagaaaacatcacttaagtagtgagatgaatgttcttatttcttatgtgcctgataagcaattgtattacatcttaaaaacacctctaacaggtgatggtacattcatatagtatattcaaatcgtttcttgataatatttagattatttaacatccatagctatttatatcaccaaatattattctttcttttacactgtgctctctgaagcaagataaagcattgtgcttaatggaatggaaagcttcctctcaaaaacccaaagattatgctacttaaatttcaagtttcaatggaacttatgtcaacttttaaattaactatgtaaaaaataaatgttgtgcatccttggatggtttctcaaaaaaaaaaaaaaaaaaggcaaagaaagaaatgcttaatgtaaactatggtggttttttacccccaactatatttatgccagctgctttgacctaaaaagtttttttatgcttatagataaaaagctttgttttagagaactcatgaaccctttgtttattaatgtcttggtaaaccacatgtcttcttgataaagcaatcctgaatcagaaagacctctttgctggatatcttacttcagtttgcttttctgtttattgattgctttgctaataaatgctctcttcattgtaatttagctccattccagcaacctccgcccagaggacaagttcaaagttcttctgctatcaatctctcctggagtccacctgattctccaaatgcccactggcttacttacagtttactcagggatggttttgaaatctacacaacagaggatcaatacccatacagtgagtttaagggtttggtaatagaaataaatattctgagaattgacacattagttaagttctttgacattgaggataaatgctgttgtggtttcctctgtctggcacagagtgtttcaaacagagataaaattacaaatttcactagtaatcaaagaaatacaataaaaatgagatgcttattatctgataaatactaatgcttatcacattctcaaagatgaaaaaaaaatgaccccatcaagaattgatgggaatgtggggaagctggaacttttataaactgctgaggtgtctgtgtgagttcattagtacaacttttcatgtacaataatttgttaaaatctatgaaaaaatctttccttttaacataacatttgacttagcaaacttattttaggaagtttatctcaagtgaacagtcattaagtagacacacaagatgtccatacctattctatttgtaacatcaaaatattgaaaatgattcagatgttcaacaatgtttcaggaaattatagtatatggcataacagaatcctggtacattgttaaataaattataggctatgatagcatataaactgataccttagttcacatatcaataaatggaaaatgttcatgacatattgtttaaggcaggggtccccaatccccaggctgtggacaggtactggtctgtgacctgttaggaacaggaccacacagcaggaggtgagcagcaggccggcgacattactgcctgagccctgcctcctgtcagttctgtggcggcatgagattctcataggaacaggaatcctattgcgaactgtgcatgcgagggatctaggttgcacgctccttatgataatctaataataaatataatgcgcttgaatcatgccaaaaccatccctcctcaccttcccatcctgggtccatggaaaaactgttttccatgaaaccagtccctggggccaaaaaagttggggaccactggtttaaagtaaataaagttattaaaataatctgagaattataccattttaatttacaaatactggaagacataataaatagatctagttttctctaattgtaaatattatagaaaatgtatcaaatatttctattataatgaattcaagttttttaattctcaggttaaagaactattaaatctggcagtggagtactaacactcaagcaaatagtgtaatttaatacacacattgctgtttccgcagagatagaacacagcaacataaacttttgaaagagaaaggatataaacaagccatcaagcctatctttgcctttgtaacttttatgaagattttaaaggagcttatagaaatcaaattattagaattcattgactttaaaaaacatttactcagatgttttagatacagtttccctaaagacagaatgaaaaaaataggaatttttacattattccagctctatcttctctgatttttgcttctagccatgtttagctacacactagtttaagaaacctcggaacagcaattccaattcaagtttctattttgttctcttcatttaatacacagttttccaaattctactttaaccatgcttaattagttggagaactgtttaaagctctgtcgaaacactgaaattccataaccttccttaaaatggttaggaggatgccttgttttaacattttaattgactttaaaactcctgcatcgcatagagttttattttgtatgcattatactgggtttcattttgcacctaattcatataactggaatttagtttcttatgtccacccctttctcttggctctacatgtctcttcagtattccaagtcttctttaaagttaatggaaactctgaacttcatgatgcagattgcaaagggaaatgaacatctgtctacatctgccatgttggcaaagtatcctgaaaacctgctactagaatgtttattttcttccaaatatcagcatgatccaggtgtcctgaaacttaaacttttgtgacagagaaagagaggagttataaaaatattgaaaatgattttgaagatgacagtaccactgattatttctgaagttgtgaattagggtcaccctactttccatacagcttaatgcaatagcaaaattaaacttaaaactatcaatgatattattcaagccagaggcatgatttccatagtaacatattgtgatctattttatagaacatcacatgttagtacaacattggctgtttttgacgattgcactaataaggaatccaaataacattttcttacataataaatgtgtattcattcactaatcagacatttatataatcctattaaacaaggtatcatttcctaaaaccatatttttcattaaaaaatgccacttctggcatttcttgacaatcactgtaattaatgatgtgaaaattatctgcatgatggcatttgaacagtaagaacaattggttaacactgtcagaactttgtatcattctaacaatagcctcatgtttattactctatttctagtgcgtggctagcatgtgtaacatgtaaaggaaacactacttatattcagctggatgaacacaaatctttgggttaaataaaggcattaggaattataggtggagaatcattgaacttttcaaagaaaattaatagtgttgtcttccaagcaagtttgatagtttgtttgagacctttatagaattcttttttagaatggaaactttttctagctggcctaatgtactatgggattctctaagacatattttccttcttaggatcatgatatactggtgtaccatctttaaagctttcaaattatttgttattataatagcatgcaaataatgaataattttaaagattgtgaataattaactttaaaaaacaaggtatatctttacgttttatttaaggtagaggtcaagctagcgcttcgagaatcatacataatcagccctaacagtatctctattgtagcccccttctgggttgctcataggtatcttacgtgtcataggaaggaagtgaacagttattggaggaaatagcactcttctgttagtgttgcaggtttagggagtggacagtaactcatactgttttttggtgttgttcctatttgagtttggaatcaaaggagcactagacatagtaggcagatcaaatttaaaaataaaaacgatcttcattactgatgaaagtcagattagagactatatcctttttcctgcaggaagacaaattagaagagagaaaaatcaatgggctgatctgcacataatttgctccctacaccctgactccccagattcacagtcagatgagttgttcctcatttgggatggcatgaatggggagatagcccttaaatgtcactttagagaaatccttccacaggaactagaggatgattatttttacatgtaacaatgacttctatcacctacagatattatcgtagtttaagcttagaattttagacaaccaaatattttaatgagccctgggatttcatttctacccttattcatttccatctttaaaattataatttataatctcatactacatcaagggatcaatgtaacaagtggtaagatgattcagttagctctgagaggaataaatgaagaaatataagatatagagacaggatgagaaaacagaagagaagatgacaggcaactgtttttataaggctcttaatattcttaatgcggtagtttccccttatccatggttttgttttctgcagtttgttactcatggtcaacaatgttccaaaaataggtgagtctacagtacaataagatgttttgagagagagagaaagaccatattcacataactattattggggtatattgttataattgttctattttattttcagttattgttgttaatctcttactctgcctaacataaattaaactttatcatagatatgtatgtataggaaaaagaacagtatatatacacacatatatatgtatgtatatatatgtgtatatgtgtatatatatacatatatgtatgtgtgtgtatatatatatagtttaatactatttgttgttttaggaatccactggagatcttggaatgtatctcctgtggataagaggggactactatattctttcctggaacaatagatcaaatatgtatagaaaaatcattcatgtgtttaataaaattttgttcagtgcttattccagaccagaaactgtatcagtcattagaaatacaaagatgaaaggaatagttctccttactgagtggggagacatataagtaaaccaaagtaacaatagaatatataaatgttgaagcagagtaaacttggggtgttaaggaagcacacggtggcttgggaggtgtaggaaatgtaaccatgcctgtggtggcaatgatgtgatggagaaccactgaaagtttcccagtaaagaaagaatataagctgaattagccagatactgtagttgaggaagcgtgatggtcatgaaataaattttgtattaaaagaaaataaggtatattcagcaatcatgggcagttccatgtagctttggtaagtggtacaatgggggagtgctacaaaccaggagggtatcagccaagatcacaaatcagtgctgagccaaggactgtaaatgtttctctgaaaatgcagaagtctgtagtaacagcaaattttcaaattcagtgttaaagatccgtaccccaaccaaggagagcaactaccttgagataagcactcttttaacctgagtattatttttttgttatggatcattaatggatatcctattcataccctttcaaatgcttttatatctttcacactataaattgccttatatgatattcctacacaaatgcatatttccatcccaattctatctgattctaatttcttattaagtagactgctcttgtataatacattctgatctattaggattatattccacttttcagatgctacaaacattcagcaagtactgtacttcttttaattgtcatcaggttataagtcttccaacttccagtttaagcttatgccagacaatcttttggaatattcagcactgaaatttatttttttcttttaggttttggcttttggcatgctaaattattttccatcgttgttctagccttcagtgatttttcaaattttgttaatgttttcaacaaccttattgtgggataagggtaactttaatctaatctagtaaatatttattgaaataacaatgagccacagctgcacgctctctagaaagtctgaatctcagccctaggggacttttccaaatatgatccttctttgggtgctctgccttagcactaaggatggtgactttcccctgtctcttctattcctatattctttagagttttctgtaccacttagaaagtaaaaccaggcgacctctggtacccatggtacaactgaaaacagccaccagagagagaactgtctcaccttcctcggctctatcagggtcatctctgataagacagtggccctcacctgagtcagtgcccaaggtgccccccacaacaccagcggaggcctcctccactgagcagtcggaccccagagtgctctgtaggagctgtagactgggaagaagggccgggtgtggtggctcatggctgtcatcccaacactttgggaagctgaggtgggcggattgcttgagcccaggggttcaagaccaacctaggcaaaatggtgcaaccctatctctacaaaaaatacaaaaattagccgggcgtggtggtgggcacctgtagtcccagctattctatttgggagactgaggcaggagaatcgcttgaacccgggaggcagaagttgcagtgagccgagattgtgccactgcactccagcctgggtgacaaagtcagaccctgtcttcaaaaaaaaaaaaaaaagaaaaaagactgggaatgcctaggtttacacgatgggttatcactccaaagatttgtgtcttttgtggccaatggcagatccaggaaagaaatgaaagttgccgatggggataggctgggggagagcaatacagatgtgtatgggaaaccccaacccatatatattgtaaatagatggactaggctaaacattgttgctgtttcagtcttctgcaaactcagcttttccacaataaagctctatctcctgtcggaaggaaggaaggaaggaaggaaggaaggaaggaaggaaggaagggagggagggagggagggagggagggagggagggatggatggggggaggggaaggggaaggggaagcacataaatatgctgggaccttcatattgctatagggcacccctgcttaatggaaccctcctcgcatctccaatgcaaacagccccatggcggagcaggcagcagccactctggtatttgtgtgtttcgcagtcctacagtgtgtttcctgtccttagagaacaaggatttccagccatgtgcctaatcacctccactccctatcttattttttaaaaacctctttgtagctgcttctctttgccctcacaatccttcatgcatagaagtcctgcttatctaaaacttctgttgtgtaaattcctcattgctgataacaaatgtctccaaaatttagcagcttaaaacaataaacatttataatttctgtaggtcagaaaataagaaaattttccattcaagatgttggccaggtgacagatttaccccttggtggtagtttactgacccttagtctggtgtgtttagtgtttaacaagcaaacaagttacatagaggaaacatagttacttttctgttttggagaaccgcaaggactttctcttagaccttctaacaaaaggacactatgaaaagcaaaagaagaactaaaacaaacatctaaacattctttattatgaatgatactttcttatactcaataataaaagcaatcaaccggtatttacattatttcaattttaaaaatatgaaatgtatccttaatcaaaagagtagattggtatagtttatgtaattaaataatatgataggaaagcagttagcaatgattcttcaccaacttgtgaaatgtaactttgttttttttttttcttttcatttcaggtattcaatacttcttagacacagacctgttaccatataccaaatattcctattacattgagaccaccaatgtgcatggttcaacaaggagtgtagctgtcacttacaagacaaaaccaggggtcccagagggaaacttgactttaagttatatcattcctattggctcagactctgtgacacttacctggacaacactctcaaatcaatctggtcccatagagaaatatattttgtcctgtgcccctttggctggtggtcagccatgtgtttcctacgaaggtcatgaaacctcagctaccatctggaatctggttccatttgccaagtacgatttttctgtacaggcgtgtactagcgggggctgtttacacagcttgcccattacagtgaccacagcccaggcccctccccaaagactaagtccacctaagatgcagaaaatcagttctacagaacttcatgtagaatggtctccaccagcggaactaaatggtaagaatccaaggctgagattcccctttttggtcaagacatgaatgagaatctattgtaattgtgcaattaggaatttggcagttgtattcctttttataactgcacaatataataattgagaaacagtttctaaagatataagatagtatttgtcctggttagtggaacaagtgtatttcttctaatctaataacaaattccattcaattaaattgccccttaaaaggctaatattatctttgctcttaatgacatctgccataacacaaatgatgtttataatttgaaactcacttatgaaatgcattatatttgactgtgtcacaagttagggcacccacaagcagtacatttttctcttctaagcaagaaaaagatataaaatgatacaaaaaatatgtatataagctaactgactccattaagttaatttttgcattcatgcatttgaacccttggttatataggccagacacacattcacagatttttaatcatttatatcatgtacatattatagcaaaatctttctttagatttgtaaagttatttggtaaaactgggtagagattgactataacatttatgcaaacagggcttatgttaaacaagttaaattaaaacctccaaatttgaaaggatacagactggagctataatgatcaaattccccaaaagaactggccattcttaacagaaattgtgaatatcaattctgaaaaagattgaatttacctatgataaagtgtagttattttttgtctatgtgttatccattttggtttgttttcctcatgagtatgcctttaatagtattttatacattcatctatatagcagtttgttgtcttctatgtacctgtcatctagattactaaactactaaatcactacattttgaatgctaaagaaattgacagtaatctaattagaaagacaatgaatatccagcactctttaactgacctgtccctaccctacccctaaagtaacccctttgtctgatgagttacgtaggttcactatttaatttctctaggaataattataagatatgaactatacatgagaagactgagatctactaaagaaaccacatctgaggaaagtcgagtttttcagagcagtggttggctcagtcctcattcatttgtagaatcggccaatgaaaatgcattaaaacctcctcaaacaatgacaaccatcactggcttggagccatacaccaagtatgagttcagagtcttagctgtgaatatggctggaagtgtgtcttctgcctgggtctcagaaagaacgggagaatcaggtaaagatcaatgttttaaattctacttttaaaacctctgaatgcaaatgtttcctcaaattaaagtcaaagtactgtgaaagtacattttgaaaagcaagaattagaaacttccatagaccaaggaaaattttcatatatatggatttgttacataaacaactcaaggtcataaagtacttgcagcaagttctagggggcaaaagtaaatgctttagttattaattcatggggcgaaaatggcttaactatagttatagtcttctgggaatgtttgtcaaaaatagcatttggtttccactcctgaagtggattggacacatgtctcatcttgctccatatacagcctaatttatgttcaatgaaagagataactgtcaccaattccacaaatttgtctttgtttttatttatctttccaaaataaatagtttagatactagattgtacataatgacagaatcgtggacatcaaaatctataattcacaagtgtgcttgtaagcagttggcatgatgataaggaaggaggacaacatatctaaattttctggattatcttcattaaggcaaaaatttttaatcctccactttattttttatattaaaacacttcaaatttcatgagcctttaagaaaaaaaatacacttttgttatgtgtttaatctgtagatatcaaagaaacccaaaccctgatctaaacttgacctgttaggaatatggaggatgagggtagctttaggttgatgtccaagggaatcatttcatgaataaaatacgcattgtgcttgagcatctcttaatgactaccagccatcttggacaaataatagagccatgatagcacaagtgatgaggcatggcattctggaaggggaaaatcaaggtcagaaatgaaaagtaatgggtgaaactgcaatactggtccctcgtaatcttatgggtcactagctaatgaaagtgcaatgagttcctttgataatacacctttggttagcacatttaaaatccctgtaaagagctcaggagtggcaggggggaaagggaaatgcatgtgtatgtaacctgaacatttcaagaaaaatttaacaaaaactttgagacattcattggggttatttagaatgctttaggtttacctctttctgaagaataatattcagccagctgcattggattggctcaatgacatatttccctacatgggaaatccagtacatcaccatgcatttttctgaactttttgaactgagatgttctatttttgtgacgttttttagatactcgtaagacttataatttcctatctatccactttcctatctttatgaacatgagcaaattcctatgagatttttattttgcaagtagaaagtagctggtaatatgaagatggagaatatactttcagataacattttaaaaagtgaataccttttacatataccagcatattcttggactttttcaaagcagaatattttaaaaggtaaaggtatttcagaaactaaatgaatgtgtgaattaaatttaaaaatatatagggacgacattcattgttttgatgttattgttattgttctcattgatagcacctgtattcatgatccctccttcagtctttcccctctcttcgtactctctcaatatctcctgggagaagccagcagataatgttacaagaggaaaagttgtggggtatgacatcaatatgctttctgaacaatcacctcaacagtctattcccatggcgttttcacaggtattgttatttttaactaatgtcctttcagaattggcttagggcttcatttggacattttttgagtttgcagaattctgtgacagaattctccctctatattgattaaacagggcattttttcttaatataatattatgtgtacaagcctccctctttgtatgtcacttgtatttttccagtataatcatatattgaaactaagttggtataatttatttcataagacttgttttttttccatttatcatgtatccttaaatattttacatgaagttgactttcattaactgtgtactatcatgttatttggacacacaataattatttaaccagtccacactcagttgatattgtattgtattaattcttttggaaatataaataacattgataaaacttcttatatgtacatttcatatacatttctacttcaaaaatctgaagaattgaatttatcacagcttataacaaaatgaattatgaatatgttcaaagttttgaatatacagtcatatattgccttctagtaattcatcccccagctagcagtagtgagaataattatcatagctaaaagttactgaggctttactgtgtacgtgaactaattcatctgatacatacagcaatcctagaggataggaggctcttgttctctccagtttacagttgtggctgatatacctctctgcccattttaccagcatccaggtggccaatagcagaagctgatggaaggatgtcaaccgaacaagttcttctgtgtatttggctgttcagtgcctcctctgagagagatgctcttctctgggcattagcataagataaaaagatctttacactttatacctactcccatagatctagccacatttttctttccatgaattcctagttcctgatccttccatctttttttttcatgcccttggccaatatttccaagccactgccatattgtccaggtacattttaccttgagacacgtctctttccacacaacatgggtgaccaggtgaactgcctgaagttctgcccactaagaggatttcttcgctctgctgtttcacagggtcatctctgacaagggttttagagcaacagctaccatttagacttgcagccacataccaagacatcctatctgtaaactaaattctgctttttttccacattctttcagctcttaagggacctcccatgggtcataggtatgagctgaggttgagccaccagtataagaatggtggatgtcatgggggcctgaaccacctgcttgcacaatgtattacggcttttggctctgcttatacccaatctcagacatccacttccattttatgatgaatttctgttgggcccttctaacctcaagacttggctgagacaattccaagattataaaaaagtagctctagctgcatggctatttggtgttccatgaccagatgttctgtttttactgaagcctgaaagcatgctagggccatttagcaaatggtatatagtttccattacatgttatgcctttgttccaagctcttggggtctatctgccctgtgattctctttctatgtgtgccttgcaacattttttcccacaatgcttacctctagtgctgtaaaaattactacatgttatgtcccaagtggctcatctgcctgtaccacaggctggacctggtgcagagccctttccgcctctgggatacactcaaaactggcagcattccatattactcagtaaatttctcagaacagtattctcaaatgtggaatatgctcccttcagaatgtgaagaggtcaactagacattttgtttccttcttagtggtggtagaagcaaggtgcaataatttgtcctttattttggaggggatatcctagcatgtctcaggccacttgaactcctaaaaacttcactgatatggtagattccttaatcttcataatattgctgtctcactttctagaacacatatgtcttacctctgcatacctaccatttcttgtttgtctgattcatttaatatgatgctatcgatataaagaatactgtcaaggtggcatttatagtttgtcttaaattggtgattaatcaccctcagatttcctttgtctttcttcagtgcattgatggcgaccagcaagatccatgcattgtccttataattactagtttccccagagtagtccttgtaattactaattccaccaaaccagtgaattaccttctactggtaactcatcgcagttcaccactaatggaagtttaagcattgcaccactagggcatgctgtggactgttagtactctacctgctgtctatgatgagatcattgtaaaccagcaagtggatgatggagctccaaaatatcattttagagtctccttcctagggccagtcctgttacgactatcttagggcaaattcccccggaagcagactcttggtagaggactgagtacaggaggtttattgggggaactctttcagaaacaacaaatgtgaagtgataaagtatgtaggattgagcagcaaagaagctgaactgtgatgcaatagtggaagcagcctcagcggattccgtgggtagttctggagctgaaatgaccctcttagcttatctcaaattaagctaggaagtcagacctttgtaccctagagtatttgtgtcctcgggctggtgtaacaaattaacataaactgagtgtcttaaaacaacggaaatttaggtgttagtacagccaggtcccccacaggctctaggagacaattcttctcttctacctacctgtggctcctggtgttccttggcttgtggcaacataactctaatatctgctgcctctgtcttcacaagtcctactctgtgtctctgtctcctctgggtctgtgtgtccgtctcatttctcccataaaaataccagtcattggattttaagctaacctgaaatccaggatgacaactaattaattacatctgcaaagaccttatttccaaacaaggtcttattctgaatttttgggagacactatacaatccactactaataggtttgccatttttttctaagcctttttaggagaccagaacccatgtacaacacacaattttattttctatactgatgaaaaagaagagccaataaataatttatgattacttatttttcattaatctgtctacgtgttcactcatttgcaattatctcatgatgaatacacaactggcataatatatatattttgacttaaacaggttagtctaccgatctggtataccatgggatttaaggtaaagttagttgtaactttcatgtggtctttgccatgttgtatctcatttatactcaatgttttattttgttgtttttactattctctggctttataaactattctttctttgtaaaacacagttttgatttatctattacttatattatagtagttgttgttctaagaaaaaaataaggtgagaaatattatttataaaatacagccttagaagtcaacctgtttgttcatattccacatctcccaattattagctgtatcacacgtctctctgcttctggttttattcatctgtgaaatgggaaaaccatttttgctcacctacctgcttaaagagcctgataaatattgacacattattattagtgattattattaatggtgtggaactacattatactttataaactagctatcatttaatggggcaggaaaataaatatttttattattgttgttgttatttaaaaggctgttccttatggctgaactggaataaggacatagatatatcaccttattctcttttttatttttatttctttgagacagagtctcgctctgtcacccaggcttgagtgcagtggcgcaatctcagttcactgcaatcttctcttcctgggttcaagcaattcttgtgcttcagccttccaagtagctgggactacaggtgtgtgccactacacctgactaattttttttttaatttttatttttagtagagacagggttttgccatctttgccaggttggtcttgaacccctagcctcaagtgatccacccgcctcggtctcccaaaatactgggattacaggcatgagccactgcactgggcctaccttattctcttttgaactctctctcctgtgcaaatattctctgttcaaggaaatgaaatcaaaagtagcagaacaaagtccaattttttaccttctcaatgattaaatttgtatctgaactgacctgagtatgtcttgttataatctttgtaaataaatagccaaaattcccagggaaaatctactataaaaataactagtaagaaacctttgcctaagaatgagacaggggggatacgtaaaagtggtgatgatgtaggattcattgtgggggatcaagctgctgtagaatttttcctacccctttgaagacttatttcatgaaaaactttcaattagatagattttataagacttataaattgactctatgtacatgataaagacaaagtctatccaagtgataattttatgctgcaagttctggggccaataatgtatttttaaaataatgtaatttataataatcatctgtaaagaaggaaaagccttttcaaaataaatattagtgtagatttcttctttcttattttatttcatcgtgggttcttgctacaaagaatattttgcttaaaaaatagttgtacttcctaaattaaataagaaatagcttcatgtactttatcctaaaaacaataccattttctaaaaatttacattgaaatctaccaggattattctaaaagggatgaatattacagcaatattcataagtttaactcagttcaaggtttattttacttagaaaattttaaatcacatttcacagaaaagtttgtatcttcattatatcaataatgattttaaaattagaaaaataaagaattacttggtatttgatgtttttcttatttcaaaatgtaattgcaaggaaatggttttaaagttttaaatttaaattattcctagagttttagaatctttaaaaacacctttatttctgaatgttattgaaacactgtattctacattccaatctcactgctttttagaacaactcatgtaacttacgaaattttaaagtcaacacctaggcaaatattccaaatgaattttattttacccctaaagagaaagtctctagaaaactactccaaatgttactgaactttacatttatctgtatttatatttatggaagattattttatatgactatgtatcagtagccctaagaaaattagttttgtactcatagttactgtcatactctctgttttaatgacttttattttctgaatataatttctagtggcctttgtacctacaacctaaacaaatttacatggttgcttttgatcacttcaaattataatgacagaaccaactctcaatgttaattgtttaataatttatttatggactgtgagtttcctgtcagtcttctttgctcaaatctgctattttcatttgaaattatatgataaagataatatttcaaataacgtaactgtttgatctaatctttatatgtttgtttatataagaaagatgattgagaattgacttaacgtggatgctcagtaatatgcttaatgtttaattttttcccctttttcttctgtgactttttttcataaagaaaatgatagtatcgatttaacatagcaacggcatttctttctgtcctagcaccatcaaatagcttgggtattactgctctgggttacttttggccaagccccatggctttgtttggactttatcatgataacaatgacaatgtcaccgtctttatctctaccattggtgacaataaccataccaccatgctgctttatgaggcaataacttggttttctcatttatccactcaggaactggattattacctcataaaacagtgtgattgtacaataatcaattaaatcctggcttgtcgagactcttcagaaaaaaaaaaaaaaacccttttcctaatggtggttggcaataattccctctgtctgaattcatggaactttgactgccaaggttatattttcacactgattacctattatctttctttctttctttctttcttttttgccttgaagctgttgcacactgctaaatcccaagaactatcttacactgtagaaggactgaaaccttataggatatatgagtttactattactctctgcaattcagttggttgtgtgaccagtgcttcgggagcaggacaaactttagcagcaggtaagcaagttttaatggatatgaaaaatctgttgcctatcaagaaaaaaaacttataatattcaacaccttctctacttgagactttatatttgtcttctcctccctcactaactctgattgcttcttacctcaacagttttaaacaacaacaaccaaaacgtaacttaaagaggtacctaggagctacgagttacagctgtgtcataataagaaatataattagtggtagagtgactccactctacaactagaaatatatagaatatacaactagaaacatatacaaatatatagaactagaaatacatagaaatgtaattagttgtagcgtgactccagggcttaactaccaacctgtgtcctagcagtgtcctgacaattgtgagaaacaatcaggaagcttcttatgaggacgttaggatacctcttccctcagtccagacattttttgtaggcttggctctactcactcctgatccatgggaacatctagaaattactgtgtggcctggtgttatatttggctttcatgaaataggtaaatgtttatctattgttttattaagaagaagcttttaagttaataaaatttaaataaaagaattgttattaagtataatctgagtagaaatggtttgtataatttgtgcttgcttcattcaggactaactggattcatacaaacctgattacatgtattagtaagacttataaaacccaattatttagcattaatatattttcaaatcagtgtttttctgattctagataaaagcttagtttcctggttatctttaaagaaatgtccatgtgtaaggaggttaagacactctagatgaattacagatattacgaaaattcatgtttacctgtaaaaacatttcctagacctcctccccaaatcccttcatcctattattaataggtccaattatgtagggttttttttctggttctggaaaaaattgcttagctcaaatgatctcatccaagtaatttatttttttcaaaattttcattaatgcaaacaactctgaaattctaagaaattatggtttactaaatttataactgaacactttgtatttttatgtattttatagatgtgcatttcagatgcatgaatacattgatggagtacctagcttgtacaaaacactcttctcctataaaactatctgtttttgtatactgtattattaaaggtttactgaatgctgaatatggacagcagaggaggactctatctcctttaaatgatacaatttcagactagaagacaaaaattaaaataagaatcagtcttacaagttggagaaagtaaaaatggagacaacggagggtgaagactgggtgtgttatagtaggggacatagggatcccaagcacgtggccatgcaaaactggaatcacatcctctcagggttgcaaaacatgtaaaaataatctagtgttactatatagccagtatcaatatattctttgtaatattcccccaagtgttcatctaacccatgtctgataccttcagtgttacagaaactactacgtctcagacaaagctataccatctttagatacctcttttagaatgtgatttcttagattggtcaaaaatatctcctagtaacttctactcaacattcttattctacttccttgggggctgtcgttaacctaatttatcatccttccaataacattttcaataacattatatccacccaagtcttttctcctttaggctgcatatcatggtggttcccatctgaacctcatatgcaatagtgtctagagctgttattagtataattcttgtagatgagatctagtctgccttttcatagatataagcaaactaaagaacctgaagagagacatgcccgtccctagaaactagctggatcatggagatgggaatagaagagcaggaaacatgtctacagaatagaatctgcctgccctatgcattagtggtaacatctgtgctaatagtatcctcattggttgcagtggcaaaatcctgttgcgtaaaagatgatgtacctgggtgctctgtgcagctctcattttagttactggtgaggcgattaaaacgactcctgtccactggcaggattgtgaagtaaaactaactagtcagagccctctgaatcctctctctattttttttatccttgaaaaatagaactggaaacttatattcgctaaaagtcatgtgacgtgaaagttagttgacttacaaaaataagagtttattcatatatgtgaggggaaaaaaatggttagccaaaatgccagggtttcaatccgggctctgccattgactagctgtgtgaccttatataaattatctaacctctgtgccttagttttccaatttataaataagcataacttatttgtagggttctgatgaggattagaattagttaatacatgtaaaatatttaaagcagtgcccatcacagttcattctcaataaaaatttattgtcatgatttttatcataatattatagaagacttttgttagtcacagtataaatgttatggaatttctaatgttatcaaaatcaaggagagtttattttacaactttgattttctaacattattataaaatataaaatggagagttctaaaactaaggattgtattgtgaaaataaaacttagaaaggcttaaaatctgaaagcattatttattatttctgtaagaagtatgtcattcagaattattatgcacatttcaaaactttgctcaaaaacagcaaatttcacatttgttggttgcaatatagagttaataatgtgccataaatgtattattactacattttattgtgaatgctcaattcagaaccatctcttgagggcttactatttaaagcactgtggaggattctaagataattatactcagcatttgggttaaggagttgagatccaacaggtaggattaacaccatggcgacatgtgctaagggctgtgagaaaggtgaaaaaaatgctatgggaaggtagaaaatgagataaatgattttgatttgggagactgagtagatacctcattaaatgctatttcagataaactataaaagaatggtaaagactttcgcagatatttactgagcacatacaatgtgctagtttctgttttaggggctggcactgttccaagtactgatgtaatgaaagcagagatttatgaagacttccctggtggtagagtacacaatagattagaagagggagtgtaataagtgtctggtagacttttttaaaaaggcaataagagagtaaatcagacgagtagaagtgaagattgaaagaagggaatggagtgacttcaaggaagacagacctggaagttaagcagtgggaaggatggacaatgatagcaaatattgcagcccatggtggtgccattaaataaaaggggaaagatgaacaaagaacagatgggagaaataaactcgtgagtttatttgatcatttgatagaaacacatccatgccaattataaccatccaggagcagaaattgcaaatctggggcttaaaaatgatgcagattttgtattcatctgcatatagatgggagctaatgctataggttataatcaattagtgaaagcagagaaaatgcaaaatggaagcccaaagaaaacaccttagtgaatattctatctgggaagaaagaagaaaggaagagtgaagtgaacagaggtatggtcagaattaggaaaagaactgagaggaagcagtatcagaaaagtcaagggaagagagaattctagaaggagaatattgtctgcagtgtcatatggtatagggaaagcaagagaaatgtgacctaaaatggatgcgaggtcactggtgactctctggggattaccctaattagcatggttgaagcagaagctggaacatgaaggattgagcagcggcaggaggagatatagtggtaaatttcaaatgtgtttttttttttttattctttgctaaaatttttcttctacccaattttcattcttcaaaaaattgtattaccttttgtttccatataaaatcctttcttttctaaagaaaaatttattttagtgtttgtttttttctggaaaaaatgtttattttctaattccttaatatattttgttagaactatctgattcttcacctgcccagcagaaaaagaaagtctcttatatgacaaaagtatggaaaaataatttttacttacagttgggtttattataaaatacatcatttttagggttgttcagatcagtgaaaataaacttatttgcttttatttgaataccaggaaaaaattataaatccatcattctttttgcctccttccttattcagtagatgaatgtgtatttctaaatgtttttccaaaacaaaacatctgaatagaaagtatagacattaaatcatagaaatacactgcagacctataataaagccagttctttagaatggtcaacaattttgctataggagagtaataaaagttgacttgcaactttactgttcatcctgctctgttttttctactattaacattgcaatttggagagtatatattattccaatgaactccaatggatttgtgggaaatttaactcttatgtctaatagctcatatgagctcattatcagacatcaatggaaacgagtgaccattcaaaaattttgaaaaagagcaccacaaattagaagtagtaattagccttttggaagcatttgaatcatgaaaagatatgttgcccccttaaatctcggtctcaaaaatcagaaagatacttgtgaagatttatcttgctgtttcattaaaaagcttgagaattataattggctctctcttgttttaaacattttttcaattaaatatatgattagaatgggtacatttcatccagagtattgcactgctgcttctttagtttcaatgcctgtgacaaagtctgagaactgatttgagagaggtgttctctcaggagcagctgcatctctctccattgcaaaatcttcaagcagtgttattaatggctttggagttgcttctgggtgtatgaaggtaatgagttgatgaactgggccctcttaaaatccttgttacacttttctttaagattctccttttaatccgagaaatttgtgcatttccacccattgcaaattgagtttagtttaaacccttcttatgagaaattacttttggagatccattcctgaagggacaatgtgatatttcccttgcctgtcataaattgacctccatactacaagcttagaagtgcccatctcgcataaaacaagtaattggtgtgcattaaattttctttctgaatgcaaagtaaaatgtataggctgtttgctgctgggttgaaaacacacattgttttgcattcgggtacataagtcttttccttgtgaataggagccagagtgattaaacaagcactcttaatatgttaatttataattttaattacaacaatcttgtatatatagtcattagtgaatactaatataaatatttttctacctttttattcataatgcataaaccaatcacccagttacttctctgaggttgcctgtttttgtttcataatacaatctttgttcttagttatgaatgcattttgttcattcctgtcttcaataatccctcattaagctagtcactttctgctccatgctaaaaaggaaaaattatcatgcaaatgtggcatgccatattaaaaagcacattaccaaacacttttgttgctgtccttcaattagtttcccttctttgaatttaattccatttgttgttaaactactgacttgatgtatggactcatgaatctgaggctgctgccaagaaagtggggaaaaaaaatcaaagcctcttcgaagagctgcagaggcgagctgaaatgaatttgcttcacctttgacaagaacacttgaacagcattggaatcctctgatgattcaacttggctaattatccaattatttatttcaagaataaaggcaccattttacaattaaggaagtgtaaagtagtctgagaaatttggtaatgacagatgacttaagtaacttctaagataaacagtatctgtgcaaaacttgtcccaccaattgttttcaggcagcagttggtgtgtcttagcatcagtgaaatcctgagtacactgaaggttttttgtttgtttgttttgctctttcaacagaaattattttacacttgtaaccaacatgtcaaatttccatggctcttaagcaatgtttaagttatatttctcttgattaaaagctttcggttcaaagcaatactttttaattgcctaatgatataagtcagttcttaggaaagaaccgcacatttaggagttcatttgcaatataactgaaaaattcattgcatggcagtaaaacaatttactgttaattacaaggagaagaatttgctgtagcatgctcgcagattgccatgaatcatgcagcactcctagagatttataacagatgtgtaaatgggatgaattagcagggtttaataacagagacacaaatcatgcagacttcaaggagctttaattgatatactagaatgtgacgggcatgaatcactcagccattcaacagcactgtaacatatggtcagctcaatatgccgcatcttaaatcggttggtgagtcgtaggttgtcccatatggtggaagcaatacatttttcatgattaaaaaaaagaatccattttttaaagaaatatgattgcaaagcatgttattgaacagtcttctgaatgccaaactgctttttttaaatgcttttttttttctttaacatggcagcttctcaaaataaataggggctactccttgtaataccagatcgctggaggcattataagaaccaaatcggtgcttgttggcacactcgatccacagcaagcctatagaaaagcgcagctgatgattgctgtgattgtcagggaaatccttcaggctggggcaaaacaaacaaatgaaaggatgatgtcactttcagagaagttcaggaatgcccagctttgtaaattgaagaaaatgagttggatgagagatccctgcttagcagggtaagaaagtggctgtgataaataataccatgacccctaaggtaacaattggatgtaacattttatactaacttcttaattaaatgctcagtcctacaggggcatgtgaaaagaagcactggctggtcatcacatagatggtagcaccaattccaagtcattcttgaagaattatttcagtatctgcaaacaggtaccctggttgaagactggtaactggtagtgtgcaaacatgtttttattggaactgggatctggcagcttttggaaaagcttttgctgcattagtaaatctgacagacttgaaaaaggaatattgcagccttagaactgtggctgccagaatttaatgtcaacaattaaaatttattttgatccttacctagtgtttattactgtttgtatacacaacagaccttactaatacagagatgcactattagatggaattaccatctgttcagagtgaaatgctggcatctgtcttagatgctaaaactaaaatgatattatttctaacaaaacaaaattaactgctttttactcaccaactttaatttgtagtgtgtagttgtatccaaggaaaaggcttgattttgaactatgtgatgacctctgtggccaggtctatatttagatatgcgactttatcaggggctctactggcctttttggcatatgaaaatggcatgtagaaatcacactttcaatacacaattatagcttcataatatactatgtatcctataagtcattaaaacaacacaaccaagctatgtaaaaattgactgaatcagagagactctactatgcaaaatattttgacagatacgccctaaaaaactgcaaggaaagaaattaaataggcaaaaaatcatctgaacaaagttgctataggtcccacagtgacatctttaggaaaatacaaactgtatctttcttctctgttagactattttaaattttctcccacatggacatatataaaaaatttacattcagtgccccctccttttaatttaaagcctaagtatcctattaaaataggtctttagcttttggaagttagagaatttggaggatcaaggacaatggtagtttccatactgatgttagatcagtgacgctactttctgagaagccagacttctattctatatatcacaaaataataaattgtgtcacaccagcatttaatgcatgtacacagtgcattaactgtaactgtagtacatttatttgtgctgcaggagacttgaaaatgatgaagaaatcgatactttgctgtcagagaagcaagtgttacgatgcatttaagtagttaattgcataagccccataaaagcttcaagtttgggtagcaaggatgccataattacagtctgagcaactaccttttattagtggtggactttagggaatggtggttgctgtcatcattgctgctatatgtgcagtttagaaataatggatcctcttctctcttcatgtgtaggatggtagttttgtgcaaattattgtgatcgccagaacaataactggttaaggtagtgtttgttcaccatgttcactgaacttctctaaaagcagggttttctttatgtcacagaacacatagacaaatcatatttgtatgccatgctaaggtaaaggaacaaggtggctgagagctgaaggggataaaccagaggggctcctgctggcttcccaggagcaaaggggatcaggatgtctggtacccattcgtggcttatgaacttagaagtactgttttaaattattcaaccaaagaattttgaaactggaagaggtcctagacataatcaagcctgtcactctaacaattgaagtaaccgaagaatagagagacctaataatggattaaccaatgttccataatcagggtcttaaagagccaatctagagcctacattttctcctttccagatcttctagtaatatcctctcctgaaggtgacttgtcaacaaagaagaaagtggcaaaatatattttattctttcttccctggtcagataatagacagtcaacaagatgatgctgagtcacccctgagagtttcgggggaaaacttttcctctttaagacactgattggtgagcagctgattctgcagcagtctctctgcaacagagaaatcagggctcatgacctggacttcttgtttgcgtcctggtccagtgcccttttgcaagtgttctggcctagcagtgtttggcaaattgtatttcctggcatagttttgcatttctgcgaaaaagtcaaaatcatattctattgacagggtgcttattaagaatgtcttatgtagtctgctccccacccacccctgaaacatagaaaaattgtttattcttaaattcttgtcatcatcatagaaagctgatgatgctttaagatattgacacagccatacagtcttcataggcaaaaaatgaacagattccttaaaaacaaatgaacagattccattttaaagaccagtacctcagaagagctttgttcagcttttagttcttatcctatggtgctcaaaatgctacactacataaattttgcaagtctaaatgtattcatttggatatactactaattatgttataaagtaataaatgctgcataaagaatgcatattataacattttataaaaatatctatacatcgaatagatagacaagaaattagattacccctattaaaaaatacaagtgctattttaaaagtacaagaattttgtacttttattcaaatagacattttattcttagaaatgatggataatgaacattcattttaaactttgtatattatccttagaaataatgaatattgaagattcgttttaaactttacatttacaagaattttctgggtaaatacagatagattttgaatatagatgaattgtattccttaatcatacataatttgaaagatttgttcttgtaatgatagcaccttatatttgtatagaaacttgttttctaaaacataaagcaaatatgtatattgttgtagaagcaattgttgtcaatgtatgtcactgaaaatgtatcctcatgttgcagatgggaaagtgggagcagatataaagggatttttctaagatcacacagatttagacattaaaaagtgaaatataatttttaaaagtctaccaaatccctttcattattcagtgttgtctcttaacgaactgttttgtaaattaacaaatctttaaaagtcatatctacttttacctatagttccttttccttgaaaatctgacgaataattcatcattaccccaatctcttggtgattctatgtgcatgtatgtgtgtgtgtttaatggttcagaagtatctatttttcttcttattctacttgtgtgtatgtgagaccagtctagtttaattgattgacaatttcacttaattcccccttccagccttagaagaactctgaaaagaataactcagtaggatgttcaccctttcaaacaggcttagttgactcctccatgtgaaactgtaaaacacacctactggaatgttttttgttttgtttttcttttaagcaagagaataaaaaatgtactctagttctattcattctcaggaattgacttctaaaggacagtcccattgctagatggaataattcctctgggaatcaagaagtgctctactacttaaagtttaaatggtaaacattaactttaatggactctcaagaatttccctattgattagaatcactttgccaaattaaaaaaaaagtgtgctctaattttcaataattattacacaaaaacgacagagttgccagaattccttttgtttagttttgtttcctattactcttaatctatattcctgtttaagacgtaatttttggattatgctactgatgggggaaggaatttgatttctgtggtggtgctgagcttcaacattatctccattgagttgagtggttggagtaaagtagagatgtatcaactttcaaacaaatgggacctggagaaaggctgctttcaaacagcaatgaaattcttcagcttttaagaagcataggaggcatattcatacttcttctcaacatttagttaaaatggaaatcctatcctcaacacaccaaatatgtataatttgtgatgctctgtctacatctttggtgtccagtatggtagtcatgaatcatatgtggctatttaaattcaaaatacagttaattaaaattaagaaatttgacattcagtttctcattctcactagctacatttcaagtgctcaatagtcttattataaggctagtggttaccgtattaaacattacagtcctagaacatttccttcattggagaaagttctattggacagtactggtaaagtagtttttggctattggatattactaggttagtagtttatgaaactaaaaagttcaggtttctgtgtcccaaaaccctagggaatctagcaaatttcaatttaaacattatgtaattggttctccattgcttccctgagcccaggactaaaaaatctttggcagctttcctttcctagttgagattatagccaagaatggcctgctaaaatcttaatacaaatatgtaactctaaactctgaagagagactctgggtgaagaaatttctgaatggcttagccttttattttgttttggattattttgaagtgagatcataacttgtagaatgaaatctttgagaacctaccatttaactgatttttagcagaaaaaaatgctaagagaaattatgcatataattcacagattcatacatatataaaaataaaatatcacatgggctgcagtggcagaaaataaccagaattgttaattatccttctaacttgatgaactttttgctcagtgccttttcttttttactaaaagttaaaatagaaccaaaatgaattgtttctttttgaaaagctggccgaaggtctaaaaagtaacaaatactaattgttctaagctgctttacggtgaatttcctttcatggtttaagggcttcaattcttatatccacatcattttgatttatatttattgaaacaggcaatgactttgcgtctgtgtatggctgtgttaacacaggtgtaaattgaaagtccacagatgtagtttgggcccttaataaataggctcggtgattatgacatttgttcctttctccacattcacctctcaaatccagcagacatacttaaagggggaataaatctcagctcacaaactcaactgtttaagggaaaaaaaaatcaaaccaaaacaaaccttcattttcaataaatcagctgttaatctgaatgagcaagttgtagggaaaaccttaatctccgtgactcctagggtttcccaggaaccttcaaagaattgccagtgtcccaccacctgaaaggatggcaaggtcccagtgtatgcaagggcatgaggtcactactgctccaaggctaagcccactgctggtggtggggtcacttcagggccagggtgctctctaggaccaagaggctgaccaaagttagttgcctggaccgttgtgtgtaaactgctgaactcacaggcttgttattttgtgctgatgctctgtttaacattcagagtgctattgcttgtttgctttcatttagatcagtttttaagctttaaaaatagaaaatagcgtataaaaggagcttttttgaccaaagaagatatacagatggcaaatacacatatgaaaaatgttctatatcatatgtcataaagggaaatgcaaattaaaataagataccactacacacccattagaatggccaaaatctggaacactgacaacaccaaatgctgatgaggctgtacagtagaaggaatgctcattcattgccagtgggaatgcaaaatggtacagccactttggaagacagtttggcagtgtcttgaaaaccaaacatgctcttaccatatgatacagcaattgcacttcttggtatttactcaacggagttaaaaacacaaaaccctgatatataattagatgtacacatatatatgcacatcatagcagctttattcacaattgccaaaacttggaaacaaccaggatatttcatcagtagatgaatgaataaataaactgtgataaactatgctacatccagacaagggaatattatttagcattaaatgagctagcaaatgatgaaaagacatgaaggaaacttaaatgcatattactcagtgaaaggtcagtctacaaaggctacatgctttatgattccaactatatgactttctggaaaaggcaaaactacggagatgagtagttacctggggttggggggaaggagagatgaataggcagggcacagaggatgttttgggtagggaaaattttctgtgtaatagcataatgatggatgcatgccatcatacatttgtccaaacccagagaaggtaaacaccacgtgtgagccccaatggaaactatgtactttgaatgaaaatgatgtgtcaatgcagatttatctactgtagcaaatgaaccatttgggtgccggatgttgatattggaagagactgtgcatgggtggggagatatggtagaactctgtaccttcttctcaatttttctatgaacataaaacttctcttaaaaattaagtctactgggcgtagtggcacctgtctgtagtcccagctacttgggaggctgagacaggaagattgcttgagcccaggagttccaggctgtagtgagctatcattatgcctgtgcatagccactgcactccagcctgggcaacaatgtgagactccatctctaaaaaaaaaaataaataaaggttacccctggcacattgcctatggtgtagccgtgctccacaggagcaatcaaaaacaaaaataatgaaagtctttttaaaaatgactttctgatgtatttttacacaagcacaaagttttggcaaactcgtgttaatattccttcattacccattggttggcacggattatgctttgcctgtgtaaattacagcacggagttgatgcctctttaaggcaaggggctctgccctatgggtttagtgctagtcattggctgtaggtttcactgcgggatcctgtggctcctgggtgaggcagctcttactcagccaagggaagttctacgcagaagggggcagccatgagccatcagaaaccaacgggcacagaaactgggccattggggtacctgcttggtagagggactgtggttggggcaccacccagagtacagcagctactataatatataagatctattatttagctaaaaagaatagagaagttattttcaagaaaaaatttaatttgaaagttttgtgtgtagtatattggccatttaaattttgtttcactgcatttaagataaactctatattgtgttttcagttcctagagccatacagatacttgaaaccacaactgatttgatttgaagtgtgatatatacaaatacatatatacgtatatgtgaatatgtgtgtctagagacagaaaccaaattcttgaatataacaggtgttttctaatatttagcaccagcacaactgaggccacctctggttaaaggaatcaacagcacaacaatccatcttaggtggtttccacctgaagaactgaatggaccctctcctatatatcagctggaaaggagagagtcatctctaccagctctgatgaccacgatgatgaaaggaatccgtttcataggaaatgggtattgtaaatttcccagctccactcacccagtcaatacagacttcactggtaagtgtgtttgacattgctttatttaggagacacgaagctccaaaatgttttctatattttcatatccctttacaatgaatttttattatacctacttagagaaatactaattcagccctttgatagcttttgcctgattgtttcagcatgtccatctttttagaattctggggaaaaaagtcaggtaagtgaaggaaaggaaaaataaaagatgaagatgaagaagcagccttattggatcaaagtatgtgctttgtatttgtctttttgtgaagtatgtgccaggacatgtttcttgaaatattattcactgtgttctctgagcaaatgagtttgcaaaatgccctcatgctattggagattctcagtatgcaccccgttactgaaactccaaaaagcattgtaagaaagctattcaactttgcttagctaatcatgcctaacagatatttgatgtaatgttttctttttctttctcttgctgtttccttcttctttttttcactgtgacaacttaatatctcatgttctatgaagaacattgtggggaaaactaatcccagggaaaagataacttctctaagccaggactatggtaaagcaagtgaggctcttgtttcggtcacaaaatttaaaggcactaaaaaactcagtgttaatgtaaattttaatgcaatatttttaaaaatgaaaatcaatgtgaaagcactataaaaatattatcaaaagcttaaataaagacagattgaactctgtaccagcacaatcctgcctcactggccttaccctcctcctggccttactagtaccgcaatattttggaagtcccatgacctctgtgacttacagcttctaatagcatgatttcaatatagctgtaaaaaaactctacttatggtacaccatttttccaatttttaaaaaaatttacaaagtataagatatatattattatgtaaactcataaagatgttcatttaatcatccatgagaaagtcattttggagcaaatagctagtctttaaaatattgcatatgtgaagacaatgaaatggaattcgagctataaaaatttgtattgttttatttttacttaaaatagtaaatagtttgcttttcattgagactggctgctgatgcaccttggtaatgaatcatgattatattctaactgagatatattgagattaatgcatgattaactactctctcagtacatcaaaatcattgcagagtattagaaattgaaccattgagctaaaaatgctcaacttctgctttatattcttaaaatggcaaaaaagaaaagaaaaaaaaggtaaggaaaaggaatacatgaataatagtaaaactcttttctcaaatgaaaatggaaactacctccctgatccaatatttggcttgagatgtgtttcttccaagaaatagcatccgtttccattcagctgggcatagctgctgcaaggatgtcagcttggatttgcaggctagccagcagacagatttttgatgggatcacctactgttgttgcagtgaaagatagaatggcccgtccaccgttaataaatttggtcatcctcgctatctcccttgctggccttatactctgaggtgcaagggctaggggcagatgcagtgtctgggaagttttccaaattcctctttaaaaaagttaggctgtaaacactggcctcactaagcaggatccttctgtctataacaaagcctccagctgcacagaaaatatgcttggagtacacaccatttgaaggacaaggcagggagatcacaattttggcttgaactactccctggagctttggtgattcctggagaatgagaagttcttctgtgttcaggcatgttctgggacattgctgatgccctttttagtggtagcttggctttacttttaagacccctttaacttttaatataaccatgtatatactaagttattggtttgatcctttggctgacttgccaggtttggctgaatgattttattgagttgtaccgaagcctaactaaatgtacccaattaatgagctaggacaggttttcaaaaccaactcaataactttctgtaaacttgcatctttcctaaatagagaggtaagcatataattagcatcttacattattcttactgatatattatcctatttaatccctctgcaaccctataaagtagctctttttaccctcgtagtacaggaggaaaagaggctccagtgagtgacttgcccattgtgccacagctattgaatttcagggtggaaacgtgaattggagccttccaaatttaaaggcaaggtctctgctacagggtggaaaggaacttttgtagactgttctttggaagtgatagaataggaagtatacaaaagtaagaaagagggataggaggtgaaataattatcacccaaatattccttatctgacactgctaaactttttggatttgtctttcagttagtttcagctcacaaacagcaagtagtgttggcattatttattcatttatttgtatccccaaagacatgtaggcatcaggtttttttttaatagcaattaaacccagagtgttactagaagctagatgtttaaaatataaataacattatgtgaaatgggctgaagtgttatgcgttaaaacagtgctttcaactcacattcctttatatttcattcagtttttatattctgaggcaaatttaatgagcaaatccttgaaacctctaatatgatgaattacattttaaaagttaataactttaagataaactaagatgtcctttgttttgaattattcaattcaaaatctcaaacttcaactaaaatgacttctgaatagaaatatcaattagtactcaaatacaaatataaggttgatgtacataattatacatattttatatatgaaaagataagttagattgtacccatcaatgacaggaattataaacgcattcataacacatttcatggccatgaacattatgttgcaagtctcagtaagaaatatctcattattgtagtacaagaaagggatctcttacacaacttatgcctctttcatatttgctttaaatatttttatcttacacaatagaaagagaataattcaagcatatgaatatatgtcctaaaatgttgtttaatattgtaaattaccaagcttaatactgtaaataaaccctgtcaatatctacctttgggcagaataaagaaccagataaagctattttgggacctatttttgcttccttttcttttctgatacaagtgttcttttaaaaaatctaatcttcaggaagaatgtattatcagtcatttacatcatagtttaaatttaaaataattaactctctgtatattattatgaggacttcgaagaagattaactgataaattactttcaaatccaggccccattatttattagctaaatgtaattagacaactcatttaatcattttttgtgcttctgtttccttttctttaaaattaacataattccactgacagtattggtatctagcaggtaggtgaggatttaaagtagatagcccacctaatgaactttgcacagtgcctaccacacagattatttagtactcattaaacattagctattagttattattcatttaataaatatttattaagtgcctactatgagacaggagctttcctaagtgagagtattctgcagttataaaatcagcattctattaatttatttgctgttacacatgcaaaatatgtttgctcaaatgttatatctagggcatgagtaatatgcaatattccatattaaaatgtgatacttaattttgctattgaaaatagtaaaattaattgacttagtggtgaggacttgggcaaactacttttctgagtgtctaatcttgctcatctattaaattgaggattttgttgcatgatcaatgttctaacctctaaaattccaattctgtgaacatagaatgtttaggaggccccacaatccaaaatacaggctgtaatcatggcatctgtgagttaaaaaaacacctagagtttaaaataaattgttttctataatattttgtttattaatacaatttaagattgatacaaatttactgcttttctctaataatttaagaaatttagtgatatgggcagagttcaacataaaatagatattcaattattgggtcatatcagatgttataaaaaaagcagaaaattaaaatagtttcgtgatcttgtaattgggcaatgatataaacaatcatggtgaaacagtgccccagttacatggggttaaaaatactttcttcttccaacacagaaatagcaaatagagcctcccctcccatatgcaactagaaggggatatcattgtgcctttggagagaaaaaaaaatcatgctcgtttttttcaggaatgcagagtaaatctacttgatttatacaaagaatttagttctttccttgtaatgctagtaatccaagtggaacctggtaaaaacagcaagtaaaatactgctcagattggcattccaaaggtgaccctctttctccttgtcacttattttttcctattagcgaaaacaggtccatgatcatttgggggaaggtttgactattgtagtatccagatgccaatcacaccagccttttaaactgcctttactggtgaccctgcccagaaatcaggaactgcctttggggagatctttgtagcaaaccactggggagatgagcacacacatgcacctggatataattcccttttatttgtcttcacgagaaatgtgattactgatgttgaatatcttgcagatgagaactctatacagtttcttcataataatgatgttcaaggacactaaatgattgtcatacatttttgtatcatagtattcaccttcccaaaaatggttgaactaaaatgctttagaatacgaaatgcaattaattaccaagggatgaaaaaagaaatgcaaccaccaaaaatcaatatgtttaagagcatattctttatttcttttactccataatatttatgccttattgttattagtcttcttatttttagtgaattgggacatttaagcacttcattaaaagaaagctgattataagcatttatagtgaaggtgcaagtagggcaaacttcttcagatagactaattagtaaaagcatattaattctgaccttcaacacccttggtgtcccactatttgttttccttggagtgggagcaagtattttgacagaaagcgcttgaaaaaaataaaaaacaaaacaactaaacaaaaccccagttcttttcaagacagatttaaatcacaaattttacctaacctttgatgttagatttcagccctagttattgaaaaacaaatataataatctactatgtgtcctagaagtttaatgaacaggcagtaattatactaaaaaagtaaaggaaagagtaagaacatggtatgtggcagcaaagtaaaggagaaataattctcaggcagtgacaaaactctgctgtgttttctgattatgaaacaatcagaagagatgagaatggttgagttaatcagtttggactgaggacaaggatcaaaatgcatatcttcttagaataacagaagtcacactgactcatgataactagagatatggagatgtaaatgtcaagactgtttattttttattatatttagtagagaggtataagtaagttctcaggaaatgccttcaggtggcattgatggcactgcgagatgggagaggaccattatttccccattcatcaactacatcataagaccaatttaagaatgcatgtgttttaacccttgccttttaaaagtgacttattttgaagtacattcctgtaagtctcccttttttttgaaatattaatgttaggtaactggtaagctgagccaacactgaaaacaaactgtttttgttagctgttagcagtattttagttaacttaaagcatctgtttttgtccatcactgttaaaatttttcaaaatgcattgtcacctgatatataaaccacacgtgtgttcctatatactcatcccacatgcataaacatatgttttccagaaggtctctgggttttccgcaaccactcaatgggttctccttgcccactgcctagacagagccagtttatcaagacaggggaattgcaatagagaaagagtttaattcacatagagcctgctgtatgggaaacttgagttttattattactgaaatcagtctcttggagagtttggggatcagagtttttaagagtaatttggctggtaaggggttgggaagtgggagtgctgattggttgggtcggacatgaaatcctagggagtcaaagctgtcctcttgtggtgagtcagttcctgggtgaggaccacaagatcagatgagccagtttatcaatctgggtggtgatagctatttcatgagttaagggactgcaaaatatctcaaacactgatcttaaattttccaacagtgatgttatccccaggagcaatttggggaggttcggaatcttgcagctggaggctgcacggcttctaaaccatcattccttatcttgtagcaaatttgttagtcatacaaaggcagacaggtccccaggcaagaagggggtctatttagggaaaaggctgttaccatctttgtttcaaaactaaattgtaaactaaattttttcccaaggttaggtcaacctttgcccagcagtgaacaaggacatattagagtttataagtaagatagagttatttaggccaggtctctttcactgtcataattttcttagttataatttttgcaaagtcattttcatttctatatagtctcaaatatacctgctcaaattgtccagtgtcttttctgccagtatgttggcattttggaatcttttcaaagacttcattgcttaaaaaaaatgctgttgcttaatgatattttgtatcaatataacacattaattttaatttccccttcattcagcttaaatgggttggaaaaggaactttgagcagaaaaagaatcataattggtcagcaatggtagtgaaactagcacctttgaagatgattgatttttgatttagtaagatgaattattttgtgtatgttttcttgaaaaaaattagttaaaacatttaaaaatgtatagttatagttattttataccagttacagcactcttgaagtgtatagattaagttcctttctattcagatagagaggaatctgggaacatcattgtcaaaatgccatctctttcaaaacttggttccagtgctctaaagaaatgttttagaagattatgcactaatgttactggcggcaaattcatatagatctgtagccacctcaatttttgcattctcagaagaaagaatttgattgaggggacataaggcatattaagagaccaagacaaattttagagcaagagtgaaaatttatttaaaaattttagagcaggaatgaaaggaaataaagtatacttggaagagggccaagtgggtgacttgagagatgatttgacctttacttggggttttatataatggcatgcttccgaggtcttgcgtcccttctcccctgattcttcccttggggtgggctgtccacgtgtacagtagtctgccagcaattgggagaagttgaatgtccagtgtgtttactgaagttataggcatgctcacttaaggcatgtttccttgccagttaagtgttcccagaaggtcatataccggttaagcgccaacattttgcctcttagtgcgcatgcttgagcccactcacccatctcctgagatctcattgggaagctgctgatcacccgtctcaggtgtttctatctatagggagactgcctttccctggcactggctgtgactgattcttattattttagagagatagtgtaacaattatcacctgacggttgcctgacatttctggtggggcgttgtggggggcggtgcttctctgaccctgcccatagtctaactgccaactgtaacactaacagtttcattgaagtgggggaaatgttaagtaataatatgaaaaccatatttaaggtatatatatataaggaggctcacaaacatagccataggccgtttgtttggagctttgaaaagggaggctcagttccttgactgatgagcagtttccatttggaaattctttgactttagtgcaacttcaaaataaaggcatgagacagaaggagagaggaagaaaccctcaagccatctaaagtcatctctggcaatggtggccatatcattttcacaaaaaaggggcatccttggggaatatcataaaggaagaataaggacttaagggaaatgtgtgggaatgattgactgatcctccctccagcagaaaattaaaaatcaatgtagatgcatttttctcagcttcttcccttcatttttttcctctcctgaaacctgttcctccttccgtgtgtaccatctacagtgaatatcactattgccttaggcggaaaccttggaactctccttgaattggcacttgaactattcactcatttcctcccattctattaatgattcctcctctggccgttcttcctcggatacatctcttggaactacctgctggtcctacgctactgcctagtccagacctatgttgtgggcttctctgccaacagtttcaatcttctccaggctgttcttcaaacgaattatttttattggcattctcttgtgtaaaaccttttaatggtttcccagcgagagatgcccttcacaaacccttttctgcttacctgctttctacctatatacctcctcatctctcccaccaaggactggtatactctctagctctagaccattttttagtcccagtgcttgaatatagcacactctctcagatgcccatctctttgaacatattgatacctttgccgggtatgccctcatctatttgcaagtacttcgctttcctttcacctggctaattgctactcatcatgaaagggttagcttagctgttcccctaaataaacttccagcaaccccagcctcctcccatgccaaatctgggttgaggacctctcttatgtactactatagaaaccaacaattactctattttagctcttaccgcattctattaagacaggttgttcagggagctaagctatgaggacgcaaaggcataacgatgatacaatggactttggggactcaggggaaagtgtgggatggggtgagggataaaaaaaactacacattgggtacagtgtacactgttcaggtgatgtgtgtaccaaaatctcagaaatcaacactaaagaacgtattcatataaccaaatactgcctgttcccaaaaacacctgttgaaaaaaaaaaaaaactggttgtttgcttatctatgtttcatgtagactgaaattatgactatctttttcatgcttaacacatttgtgtcttgcacggcataagacatttaccagatactcaataaatatttattaactaaatgagtgatagaaaagagggaaatccaaaagatggatcacttagctgtaagaattatttaatggcaaaattcattatgcttttgaatatagttcacatttttaaatccacgtttttgaaagtattgatggtttagagtgataactcaatttgtttagtctctattggccttagatgtgtaagaaaatacattttaaactgtatagtaccagagacaaaaagaaatttcttgttaatggtcctcagttgctggcaaagttacttgtacaccagttgttatagctagagtgttatatcagaaattgttttctgccccaccatagctatcacattgtgttgctgaaaactaggtggttgcacatctcttagatacatgatctccttaggcttattaaattttgaggttaatgaatattttgacacttttacctatacatatcattagggcttattgcaataggtttaagatgacagtcataataaacatatacagtacaataaaaagcacttttaatcttgaaagtgctttaaaaacaacagtgatcaatgctatggatggattaacagcatcatgctgattgaattctatttcaaggacaatggaggtattgatgttggcagtctagttcagaaagtggcaatggctgtagtaaatggtgcaggttctggagtcagactccccaggtttcaaatctggctccccaacatgctggtgtgcgactttgcacaagtcattcccccagtgtgaaactcagtttcttcatctgttaaatggcttattgtaaggtttcaatgcaatcactgtaaaggattagtacacagtgtcttagtattgtgtatgcatttgtgaccagcattctgtaattctggacttcaattatgtgcctttccattgcatacatatattttatgtccctaagtcacataaatcttgttgatacttctttatgacctctctctactacacggtactctgatcattcactttattttactcattctgtgaacctctgacctgttttttgttgtcattgttacctttcttcttccactagaagcatacatgttctgcatctcatttctccacatctatttaaacagccaactttaaatgttatgtgtacttataaacctaactctattattccccctgtcttcataatcagtcttctcgaaaactaagactctctatgtgtcattttctcatggatcaattactcctcaatctactgtcatttggattcttttcttccacttctttattgtaaatactttcttctagattatcaatagttttcaagtcagagaactttccttaatcctcaccctatgtgccaataaataatattggtgccattttttccttttaaaaaataagaagaaactaaatatttctcactaggtttctccttctattttccctaaactgtgtttcaagctttgatattgctttctacatccacctttaaatggaagagttcaatcactcattcggttcgtatgcagtttttccttatttcactccactagctgatgttatgattgctgtcgtaaaaaggatactgagcaacacaagaatgattcctaaccttagggagcttaaagtcttgcagtgaaatcatgcatcaaacatgtaattaagtaattacaagtgacttctgtctccagctatgaagcatatcaaaaaatcctcctgctgagaaaagaaatagaagctggaaaaaatttctcaaaaatatggttaaagacataagtgagtaacaaaggcttctaggacttgtgggatcaagatcctagatataagaaaaaccatgtaggtgagccttttaaattatctttgtttttccttctgttttgtttgttaattcctctattgcatagtcttagggaaaaaaaaaagacaggcaaaaaattagagtctaggtggggtcctggtatacatgccaggttttcaattgaaatcctagaagagcaaatcattaataggctcttcttcctcagataaagcctcaattattcttaactactaattatactgagataaaagttatttttttaccaaaaatatttagatatttgctgaaagatcacatcaaccagagtcccagagtgtgcaattttttcctatacaatgtcgggcattcaatcaaatattaacaggcataccagaaaatagggccaaataaccaaaagataagataaataaaataaaaaatagaaacatatcctcaagtaattcagatatatggaaatatgtatttgcatacacacataggcatatacacacatatacatgtagatatatatgcatatatccagacacagactttaaaataactataattaatattatcaataaaatcaatgaaaatgttcagaatttaagtagcaaatgggaatatattagaataggaattttagagcggagtaacagctgaagttagcaactcagtagataaaataccaattccatccctgataaagtaaatagccttgttcttaatatcgtatgcaacaatgtaagttgggaacaaaatatatatgaaacacctatttgtagccaatatatagcaacagtgcagagctattatgcttaagtgaagaaaagcaaatgaactgagttgcacacacctggaattattgagctcaagcagagacattagtatatctggtaaaggaataaaaactggaattcagggctacaaaagtagatttggagggtaggttcccagagagaagattgatgctgaaaaataattcaaaaattctgtgtaacaattcttttttgggtgcttggccaacatttagaataatcctatgagaaacatagtagagaagatctgcttggtagttggagctaagtagagatttcacaggcaacatagagctaaggatgcacacatggagtttggacttaaccacagtagagaaaccttggtgaatactctgagctttcactcgactctccaaaagtccgtcctttatgagtaaattcccatgctttaggaataagggctattctttaggaacattgagataattgaaacagattcaccctagtgaagcctaaagccaaggctgagtaaggtcgaggtaatctggtaattttacttcccgtcaaaacagaattttgtattcattagtaaaaggtaaaataatccagaggttttactatgcgtcatccatgaagtgaccaataatgaaatgttaatagtcgatagaggcagacaaagacttcaaaataacttcagttaatgttaagagaaaataaaggacaaggtggacagaaaggatgataagataaaaaatatttcaatgcaaaattgaaatctgtacagtaattaataggaaaaaatggtatgtaaagtaaaatacctgaaatgaagagaatattgataagttttgccaatgaaacattgcagaaggcaagattagagaactcaacggtcaattgtaattgtccaaactgaagcatatcgagaaggaaatgaaaacatgaaaaaaagaacaatgaggtatttgaggacccagaaggaaagagtgaaagaatgagacaatagtaatattgtagaatagccaaatattatcaaatatgaaaaataagttcacacatagtttaacaaagtttagcaaaccataaggagggcaaatataaggaaagccatatccaggtatattacagtcaaattgcttaaaataaaagacaaagaaaaaccttcaaaagcacctggggagggtggggagacttattaccttcagtggagcaaaaataagaatgatgtctgagttttcaacaacaacaataaatgaatgccagaatataatggaatgatactttttaaatgctaaaattatttttttaacaataataacaacaaaagaaaactaccagtcaagatttctgtacccaggaaacatatccatcaaaaatgataaaataaaatatttttcttaacaaaagagttgaaaaaagttatcatcaaaagactggcattataaaaatcataaagtgtattaggacataggaaaagatcccaaaaggaagcacagagctgcaggaaagagtgcaaacctctagaaatggtaactaggtgtgtaaataaaaagtaatatttatgataaaaggcataaaaatcatactttgaagttgataacatgtaagaaaaaatgtatgacatcaattattttgtcacaaatgatgacggggtctatatggagctaaactgtggtaaaattcctaaaaagttatggaagttgaagaattaataatatgaagtaggccatagtagatcaaggattcagattatgatgccaaaggtaacaaccaaaagaatgatttagaaaattaatgtaaggaaacactaaatgttaaataaacacaggttaagctgataaaggagtttgagggtggcaagaagaagccagaaacaaagagcaaatgtggggaataaaaggacaaataccactgtggtgaacataaactcaactatatcagtagttgcattaaatctaaatagtctacccaaataagcataaaagttctcagattgatttaaaaaataaaaatatatgttgtttattcttataaacatactttaaatataaagacaaaattcgaaaacaaagaaagagataagatgtattgatatatagatagattttaagacaataaatgttagtagacaaaatggaggacatttcataatgacaaaaagatcaattcaatagagggacatataatcctaaatttaggtgctacttatagtttcagatatgtatataaaactgaagttgacagaaataaacagagaataaatatatcctcatagttgaagatataaatccccatctaatattttgacaggaaaagtacacaaaatattagtataactatcaaagatttgaaaatgaataaacaattacatctgtatataaaacatgtgacattttataagtgttgtcatatgtagaacatcacttccaacaactatataatatgcatttttgaggaacacataggacattttccaaatagttaatatcctgggctatagaaatcgcataatttttttttttaagagacgaggtcttactgtgttgctcaggctggtcttgaacccctgggctcaagcagtcttcccacttcagtctcccaaagtgttaggattacagatgtgatgagccactgcattcagcttgatctcataatatttcaagttctctgacaactgtgagattaaactagaactccaaatctaaaacataatccgattggaaaatatccctggctcaaaaagaaattatggaaattaaaaattatttttatctaatgataataatgccttaatacatataaaaacattgtaggatggacaatatcaggaatctgatattgctttatagctttaaatgcatatattagaaaaagggaatagttaacaatcaattagcttcccactcaagaagaaaccaggaaattaaagcagcatatgacacccaaaaaatatttgaataaaagaaattataaaaataagagaaatcaatgatatagcaaacagaaatgtaatggagaaaataagaccaagaattgattctagaaaatttggggaaaaatttctttgcaagtgatcaaggaaaggagaaagtacagattactactctcagggatgcaaagagccattactagaaatcttacagacattaaaaaaaataataatgtattaagaacagcactacgctaaaaccttgacaatacaggcaaaatacagagatcctttgcatgggagaaaaatctccaaatttaaactgacacaagaagatctagaaaatctatgtggtcctagatgtgttttaaaaatgaaatctatagttaagtcttttacataaagaaaaccccagggaaggtggcccgattggtggatttcatcaaacaattacagtagaaataatagcaatcctacaaaaaaactcttacagaaaatagaaaattgcaatggtttctatctcattttatgaggtcagaagaacttatacactaaaatctgacaaagaaattaacataaaggaaaacacaggtcaataataatcacaaaagtagattctaatattctctgtgtgtgtgtgtgtgtgtgtgtgtgtgtgtgtgtacataaataaaatgttatatcatgaccatgcaggttttattccagtagtgtgtaatcttttcaaaatgtatgtgattcaacacattaacatagtaaaaatgaaacattctaaattatcaccacagatttaacaaatgcatttaataaaatataataactattcataacaattctcagcaaactagtaatgaaagaacacatcctaataaattgtttttgtaaaagacctctaatagtaaaatatcaagtgctttttcccagaggtcaggtacaggacaaggaaattcactatcaccacttttatttaatgttgtactggaagtatagtactagccagagcaatatagcaataaaataaataagtattaggtatgtcaaagaagaagtaaaccatctttatttgtagatgtcattatttttattgatgtcaaaataatatataaactattcagtttactcagtaaacttagaaaagtgtcgaataaaggtcaatgtacagaaatcaaatgtttctattgaatagcaaaaaacaagtagaaaatgaaatgtttaaaagtaccatgcttactagaactaacacacataaatgacttagaaacaagtctgctaaaaggtaatgtaggacctccactctgaaaactacaaaaaattactgtgagaaattaaagaccaaataaatggaaagttacgccatgttcatggatctaaacacttaatattgttaaatagcaagtcttcctagtttgatctgtagaatccatatagtccctctcaaaatcccaggatttctgtaaaaatttacaagctaattttaatatgcacatgagagaggaaagtacttagagtagccaaggcaatactaaaaaagggcaaagtaggaaggcttatgtatcaagactaactataagactgcagtaggtaagcatgtatagtataggcaaaagaacagataagtatagtaataacatattgccacataaataccccaaataaatacatatatatgcagggcacagtggctcacacctgtaattccagcactttgagaggccaaggcaagagtattgcttgtgctcaggagttcaagactagcctgggtgacatagtgagacctcatctctacaaaaagctgaaaaattagctgggcatggtgaggcacctgtagtcccagttactcaggaggctgaggtaagagaatctcttgaacccaagagttcaaggctgcggtgagccttgattgcaccactgcactccagcctgggtgacagagcaagatcctgtctctaaaaaataataataatacatacatacatatgtgctctaaaaagcacatgcaaagttgttcatagcaactttatttctaataatcaaaaactggtaacaatccaaatttctatcaacagtagaatggataataaattataataaatttattcagtggactgcatatagaaataaaaatgagccaactattgcttcagagaacaatgtgggtgaatcttataacctgttagtgagtaaaagaagctagaatctaaagagtctagtattctatttatataaatttcttctttttcattttaacatttattttaggtataatgggtacaacatgcgggtttgttacttggctatattgcatgacgctaacgtttgggctatgggttccattacgcaagtagtgagcgtggtatccaataggtagtttttccaattacagtcccctccctcccttccagtgtctgttgttctcatgtttatgtccatgtgtgctcaatgtttagctctcacatataaatgaatatgtagtatttggttattgttccagcattaattcacttagaattatgaactccaactgcatccatgttgctgtaaaggaaatgattttgttcttttttgtgattgggtagtattccatggtgtatatgtaccacattttctttatccagtccatcattgatgggcacctagattgattctgtgtctttgctattgtgattagtgtagcaatgaacatatgagtgcatgcgtctttttggtagaatgatttatttttctttgggtataacaggattgctgtgtcaaatggtagctctgttttaagttctttgagaaatctccagactgctttccacagtggctgaactaatttacatttccaccaatcgtgcataagcattctctcttttccacagccttaccagcatctgctgttttttgactttttaataataaacattctgactagtgtgagatggtatctcattgttgttttgatttccatttctctgacaattattgatgctgcacattttttcatgtttgttggttgcttgtatgtcatcttctgtgaagtgtatgtttggctgggcgcggtggctcacacctgtaatccagcactttgggaggccgaggtgggtggatcacgaggtcaagagatcgagaccatcctggtcaacatggtgaaaccctgtctctactaaaaatacaaaaattagctgggcatggtggtgtgtgcctgtaatcccagctactcaggaggctgaggcaggagaatcacttgaacccaggaggcaggggttgcagtgagccaagatggcaccactgcactccagcctggcaacagagcaaaactccgtctcaaaaaaaaaaaaaagagatagaagtatgtgttcatgttctttcccattttttaaatggagttgtttttcttttgttgatttgtttaagttccttataggttctgcatattagaactttgtcagatgcataatttgtatattctgtaggctgtctgtttactctgtggatagtttcttttggtgtgtgtgcagagacactttagtttaattaggtctcagttgtccatttctaaagctgcaaagtgaaatcagtggtgacagaaatcagtagatggggtaataactgaaaggaagcaaaaagaagccctctgagattctggaattattttataaattagtctgagaggagtttataagtgtagatttattttgtaaatgtccatcaaaatataccttgataattagtgcactttatttttgttatactttactttgaaaagttactgaataaatgtttcaagcctgcaaagtccaaaaataagatgtgaaaaaatactgtaacataacagaagcactcaacccagtctagaggattagtgaagacctctccgaggatgaggcaagttgagttagctaggccaaaaaaaaaaaaaaaaagaaaaaaaaaagaaagaaagaaagaaaaagaaagaaggaaagtaaaggagtccaggtagagaaagtatcatgtatcaatgtcttaatgtgggagatgacatgtacataaataaacaaattagtaagcaagaaaaacttggaaattctaatataaattagattcttgccagaagggtgcatggtgaggctgaaataaaaaaggggccagatcatgcaagggccatcacattgaaaattttgaacgtaattttattcatctttataagaccactgtggaggttacagcctgataccaagaatgtttttaagaagggcatgctgatattttcactgatattgtacatgtaccattcatagattgactcactaaaagttgcaattttatttaatcatctaataagattatttatagaatgtctgcaaaatgttagaagatcttccttataagaattagcatagctgaatggtttaaaaaaaaatgaaattctgaatcccagcatggatctattgcattcttgcaattgtccaaggcaaaaggttctgcttgcctgcttcataaacaaaatcaattaaccgagactgcagcattgcagtaaaaagtttaatttaagccaagccagccaagtggaagaactggagttatcactcaaatcagtctctctgaagtcttgaaggttaggatttttatggataatttagtgggcagaggggctagggaatgggtgctgctgataagttgaagatgaaatcataagagcatggaaaatggtcctcctgtattaagtctgtctctgggtggggcaacaggatgggttgagtcatgagtcattagtccaggtgggatcagtttgaaaaacatctcaaaaaagcaatcttgggttttacaatagtgatgttatctataggagcaattggggaagtcaccaatcttgtgacctctgaccacattattcctgaacagtaagcaattataaaaattacacctacattttagcagcattcaggcccctcccgtaatcctattcttgtggcctttcattagtcttatgaaggtggtttttagtctctgagaagggaggaggttagttttagggagggatgatcatctatgatcatctttgctttcaagttaaactatgaactaaatttctcccagtgtccaggaatggccaaagacagcttgaaggttagaagcaagatggagtcaactatgtcagatttctcttactgtcgtaattttgtaaaatcagtttcatcctaatctctggagaagtacctagaaatttgcatttggataagatatacagatctacactattaaagacagagctatcttacccacccccaccccagctatttgtctaagggaaatgaaacaatttgtacatacaaaaggctggcacacacatacgcattgcgcctacattcacaagagccagaaactggaaacaactcaaatatccatcagtaggtgaattgattaataaaatgtggtatatgtatgtgatgaaatactagtaagcaatacaaaggaaagagcagaagaacacttaatcgtaattccacttatataaaattcttaataataattaatgtatagtgacaaaaaggagatcagcagttgcctaggcctgaggaggagggggtgatggaaatgctgtgtaacaatcaaggtagtggttttacaagtgtgtacatctgtcaaaacatatcgaactgaaccatttaaacagatgtgcttcagtatatatgtaaatttttatctcactaaaattaataaaatattctccaagtgattcttgcaacattcaagtatgggaaccattgatttacactgtaatgaacaagttgctttaactttgtttggaaaccaaacaattttaatattattttaccatttaaattctgagctctttcagatagaaacttaagcagtgtgtatactgcttatcactccaaatttcacctgaaacaaattggtatatactgtttgtcataaaaataagaaaatgactttcattaaattatgctgacaatgagaatcttgtacaatttcaatgaaataactttttttaatgaaatagggtttcttttgatctcattcacattcagaagggaatttttgtaaatagaaaggactatattttattttatcctaagaaggaatttagtcagtaaaaatatgaaatagacacttgagtatacagttgaccagttattgccttgaagctactgcacctctgtaatgtatttttcatagcttatataatccgtgttaatatgctacattattaagttcaactgtgagaaatatagttgcttgaaaacagatttcttctgcatacttataaattcagtagttggaaaaaaattaaagaaatataattaaagattgcaaaatcaatttgaccctcacttaaaatgtgttgagtggaggcagcaagcagcagcctacatctgatgctgttctctccttgtttacttcacaaaactgtgcaaattagaactttaatttacagagctgttaaagcctcattaaaaactttcagcaagtatcctattttgagggtttttttccccttatatctaatatgcagcattatctctgttttgtgggcatgtatgaggcaatatctataggcatattaatgtaaactgcatatatgaaatgaaagtttttcacatggaaaggacactagtggtgtctgtcaattgcttcccaaagtgattaatttctccatttacttggtgtttattggcatctactaacactggatctctgttggatcataggaatataattgggctccagtgaaatgggagaattccctgacaccctgttgcaggatatgtgacagaggtgtggcttgtctgcttgaccgccttgcactcaaactccttgcaggagagggagcatgcagatgggcaggtgtgggagccagggcaagaacttttgggctccagtcccatggtagtatctaggggtgggtgcttgtgactcccaaagccccagtgggtgtgttacaatgcccttttagctgtgccatccacatatggcttaagtgttaaccagctcagtgctttcttggtacctgggttcttgtccggtgtccaagaagaatcaggttacatggataaactgaaggatggtaaatgtgggggattttattgctggatggaggtggctctcagtggaatggatgggaaactggaaaggggatggagtgggaagatgatcttcccctggagtttgggcatccggcggccaatctcctctctgactaaccccagccgaaatcctctcaatgttcagatgctccttttcttctcttcttctatgtggcactgctctgctattctcctgttcctctgctcttctgctcatggagcctggggtttggggtttatatgggtataggatagtggggcatggtgggccaaaaggcaacacttgggtgtgaaaacagaagtgcctttttttatttagggctgtgggtttccaggcttcagggtggggcctttgccagggaactgccctcttctacccagcatttccctgcctcctgtctttatcaccagtagacttgttccctgctcttacaggatttcatgcgtgtccgtgtgaagagaccaccaaacaggctttgtgtgagcaataaagctgtttatttcacctgggtgcaggcgggctgagtctgaaaagagagtcagtgaagggagataagggtggggccgttttataggatttgggtaggtaaaggaaaattacagtcaaagggggtttgttctctggcgggtgggagtgggggtcgcaaggtgctcagtgggcaggagtgggggtcgcaaggtgctcagtgggggtgatttttgagccaggatgagccaggaaaaggactttcacaaggtaatgtcataagttaaggcaaggaccggccatttacatttcttttgtggtggaatgtcatcagttaaggtggggcaggacatattcacttcttttgtgattctttagttacttcaggccatctgggcgtatacgtgcaggtcacaggggatgcgatggcttggcttgggctcagaggcctgacattcctgccttcttaataagaaaaataaaacaaaatagtattgaagtgttggggcggcgaaaatttttggggggtggtatggagagagaatggacgatgtttctcagggctgcttcaagtgcgattaggggcggcgtgggaacctagagtgggagagattaagctgaagggaggtcttgtggtaaggtgtgatattgtggggatgttagaagaaacatttgtcgtatagaatgattggtgatggcctggatatggttttggatgaattgagaaactaaatggaagatacaaggtccgaataaaagaaggaaaaaaatgggtattaaaggactaagaattgggaggacccaggacatccaattagagagtgcccaagggggttcagcgtaattacttgcttggttggcaagtttttgggctctatccttgagtttttttatgttgtcatacaccaggccagattgatttaggtaaaaacaacactcctcatttaagaatatgcagagtcctcctttttcagcattgagtaagtcaaggcctcggcggttttggaggacaactgcagctaaagagtcaacttgggcctggaggactgataaagtttgtgatatgtgtgtgatgctagcagagaagtcattagacaggctacagaaggtcatgacagacgttgaaatgcctgctattccagtaccgagagcaatcatggaggcagaaagtcctaaaccgaccatcaagggaattagtggaataactcttttttgtcatgtcggtgtcatgaggggaacagggagctcttcggtcccatttgcaaattgaattttgggggtaaggaagactagtgtacatgtggctgtccaattggcaggtagacacatgtaggtagaggatccacagaggaagaagagaccttgtgcgaggcaaaactggagatgtaaagtaaaaaggtgagaaggagtgctgaaaggggtgtcttgtacccagactcctagggatccacctagggcggcagctgtcagaggttgtaatggggactgatggggtaactgcgtagagggggaggttcgattttcatggtgtatgagaaaacgttgagtatctacgagcaacctttcactgttattttcggggctgggtataagtaaacaagaagagggcctgggaggagagtctgatgagcaaggggaaggtagccaaggatggagtgaaatacagggcacgtgtcttcctaagcaataattactgctaatgtttttaagtttgtcagtattgatagagggcttgtctgtaatatggagctggaaggctccaattgtttcagtgatgtgtgtagttggacttcggagatgaagagtaaaggaacatcgagaaggtgaaaggttacccaggggaattccagtgggtctttgccgagagatacataaaggagcagccacaggaatagtagtttgtgttgtgagaggtccaaatatggggggagtagagttaatataaggagaaaggttttttaaataagtgcgaaggagggcggcagcttgctgatgtgaaatgtctggggaagtcttgctgaacctgtctagaaagtaaatgagttcttcaggagggtaaaggtgagggctgttaaaggaagttcggaggtgtagggagacgggagatgttgcccagtctgtctgtaagacggggacagctgtgtaggcactggaagaaagggaaatgcaaagccagcagttgttcgctaaggagggattagaagcagctaggagagaatgggttaaggttgacagtgtggtggagatagctggggagaggtagagggtgacataagaatgggaatgagaataagagtgagtataaaagtaaagaatagaacttcatcagggtggaagtattggagggtgccttgccagcaaagatcatctatccactttaagagggagttaagagtggcagtttggggatagcaccaagagatatcagctgtgatggcttgaagaaacagtgtaaaccagcagtgtaaacaagagtagggcatttataagtagttgagaatggagaataggagtatgaccggacagaagatagtagggatgactagttttttggggctcggcctaagtggtggggtgacttcgtaaagccctgttgcaaaaagtagggtaaggacgaacagacctaatagaatgaagggatgtattaggctcataagggttattactgttcttcagaaatacgagtgagtttaagggaagtgggggagagtacttgcgacttccaggaggaagaggagggattaggctggctgtccgatggacacagctttattctggaatggtgaacccagtggggaggatcctgcaggcggacggcagtcggggtactatagatgactaagtagggtccggtccattgaggttatagagtttgaggggtcagattcttaacaagaactgatcgtccagctaggttgtcttcatatggctggggatctggagtaggcaagagaagattagcagcctggcgaatttcctgtctagcctgctagagcactggaagatagtagcctagagggctggtgtctgggatgaggttggggccaagcaagaaagtgcgtccatataaaagttcaaatggactgtaccctgtagcatctcggggacaggctctgactctgagaagagcaagaggtaaaagtactgtccaatcctttttaagttggaggctgagcttggtgaggtgtgccttttaaaagaccattagtccgttctacctttcctgaagattgaggacggtaaggggtatgaaggttccactgaataccaagagcctgagaaactgctttggtgatttggctagtaaaggctggtccgttatcagactgtatagaggtgggaaggccaaaccggggaattatgtctgacagaagggaagaaatgaccgtggtggccttctcagacccggtaggaaaggcctctacttattttgagggcctctaacagtattaaagcagcggcagccgctgcacacagacatgagggctaggttaaaacagtaaggtcaagttgtttggacagaaaggctacagggtgtggtcttggctcttgtgtaaaaattctgaccgtgctaaccatgcctaggaaggaaaggagttgttctgtagaaggtgcttgggtttgagagattagtcggacaggattggcagggagagcacgtgtgtttttatgagaattatgccgaaataggtaacagatgaggaagaaatttgggcttgattgaagtaatgggggctgtctgtgaagctttgcagcagtacagcctaggtaatttgctgagcttgatgggtgtcagggtcagtccaagtgaaagtgaagagaggctgggattaagggtgcaaaggaatagtaaagaaggcatgtttgagatctagaacacgataatgggttgtagaggcaggtattgaggataggagagtatatgggtttggcaccacagggtgtataggcaaaacaatttggttgataaggtgcagatcctgaactaacttgtaaggcttgtctggttttaggacaggtaaaatgggggaattgtaaggagagtttataggctttaaaaggccatgctgtagcaggcgggtgataacaggctttaatcctttcaaagcatgctgtgaggtgggatattggcattgagtggggtaagggtgattaggttttaatgagatggtaaggggtgcatgatcggtcaccaaggagggagtagaggtatcttatacttgtgagttaaggtggggggatagaagaggaggatgcaaaggaggctttggattgggaagaagggcggcaatgagatatagctgtagtccaggaatagtcagggaagcagataatttagttaaagtgtctcagcctaataagggaactgggcaggtggggataactaaaaaggagtgcttaaaagagtattgtctaagttggcaccagagttggggagttttaagaggtttagaagcctggccatcaatacccacaacagttatggaggcaagggaaacaggcccttgaaaagagggtaatgtggagtgggtagcctccgtattgattaagaaggggacgggcttaccttccattgtgagagttacccgaagctcggcgtccgtgatggtctagggggcttccgaggcgatcgggcagtgtcagtcttcagcccctaagccgagaagatctgggaaggagtcagagagccttgggccagagttccaggggctctgggagtggctgccaggtgagttgaacagtccgattttcagtggggtcccacacagatgggacgcggcttaggaggaatcccgggctgcgggcattccttggcccagtggccagatttccagcacgtgtagcaagctcctgggggaggaggttctggaggaatgcctggccgctgcggttcaggcgtttggaagttcttgtgtgctggagatgtggctggggtttgtctcacagtggaggcaaggaattgcaacttttttctattatggtacaccttgaaggcgaggttaattaaatcctgttgtggggtttgcgggctggaatttaatttttggagttttatttaatgtcgggagcagattgggtaataaaatgtattttgagaataagacggccttttgaccttttagggtctagggctgtaaagtgtctcagtgttgctgccaaacaagtcatgaactgggctggatttttatatttgatgaaaaacagcctaaacgctatctgatttgggataaagaaaaaggagcattaaccttgactatgcctttagctccagccacctttttaagagtaaattgctgggcaggtgggggagggctagtcacggaacgaaactgtaagccggaccaggtgtgaggaggggaggtgataaaaagattatagggtggaggagcagaggctgaggaagaattgggacctagctcggcctggcgaggaacaacctggggaggaagggagaggtcagatgggtctgtagaaaaggaagattagaaagactcagcgatgcttggggttggtactgaggggacaggcaggagggaaagaaggaagatttgggatgagtttaactggtcacagagactaggaagggactgatgtgtaaaagaatgcctggatgtcaggcacctcaggccatttgcctattttatgacaagaattatttagattttgcaggttggaaaaattcaaagtgccattttctggctatttggaactactgtcgagtttgtattggggtcaagtggcattgcagaagaaaataaggcatttaggttttaggtcaggtgtgagttgaagaggttttaagttcttaaggacacaggctaaaggagaagaaggaggaatggagggtggaaggttgcccatagtgaaggaggcaaaccctgagaaaagagagcatagagacacggaggaggggagtggggttcttgccctccagaaaagcagagagggggttgggacacggaaataagggattggggcacagagataagaggtcagggtgcggaaataagggattggggcacagagataagaggttggggtgcggaaataagcgattgggggtttcttgccccctaggaaagcgggacttgccgctaagggtgaaggagaaggggttgaggggtacttgcccctgccccaggaaagcgggacttggcgctaagggtgaaggaccaaggcaggtgtccctgcgtggtctgacacccttgaaacgtgagtgtataatcagagaggtgtccctgcaatgattaaacaccaagggaaggctgccttcccagtctgtgaccagcgccggagttttgagttcacggataaaacatgtctcttttgtctctaccagaaaatgaaaggaattgaaattaagagaagggagagattgaagtgtggcaccaagattgaaaggagaaagcggttgagggatagtgagggaggttggagaagagagtaaaaaaggccgcttaccggatttgaaattggtgagatgtttcttgggctggtcggtctgaggacctgaggtcgtaggtggatctttctcacagagcaaagagcaggaggacaggggattgatctcccaagggaggtcccccgatccgagtcacagcaccaaatttcatgcgcgtccgtgtgaagagaccaccaaacaggctttgtgtgagcaataaagctgtttatttcacctgggtgcaggtgggctgagtccgaaaagagagtcagcgaagggagataagggtggggccgttttataggatttgggtaggtaaaggaaaattacagtcaaagggggtttgttctctggcaggtaggagtgggggttgcaaggtgctcagtgggggtgctttttgagccaggatgagccaggagaaggactttcacgaggtaatgtcatcagttaaggcaaggactggccatttacacttcttttgtggtggaatgtcatcagttaaggtggggcaggacatattcacttcttttgtgattctttagttacttcaggccatctgggcgtatacgtgcaggtcacaggggatgcgatggcttggcttgggctcagaggcctgacacaggacttgtgggaatataatccatggctgtttgactactctgaactgttatactgctgtttttctgcccagggggatgttaaagccaaaagcaagtaatcaacaagattttttttaatcttaaaatactgaattaagccttaacctttaaaacaatttttgttgtagacatagatttgctatttgtttcagacatcctttaggcttttgatctagcacatgactaccccttcttaccgcattgcccctggatcccccaaggagagacacatggctacctcctttgtaccttggcccttgctgtactgatcacagctagttaggacagctatgaaagcctgctccatgcagaactgattctgttcgcatgagaatttggaattggaatttagagctaaccagttggtctgtgtttgtcctgaacataacataaaaattaattgaaatgagagacagagagaggtgtattgttgtgggggcgggtgagaaagtagggtgagggaagggaaggagggaatgctgaagtatagagcagagagcagcagagaggtgagaaacaggaaaacattcctcaaagcttctccactcccagtccaggaatcttgcctagccttgagttacagaacacactgttatctctggataatacatttcctattttgctcaaagtcctggtgtgaatatgcaaccagagatttttaacgtaaaaagaagctatgagcatatgaatggaagttgaagacctgagaatggactaagggactcagggttagggacagaccctaggaggaaagatggcattcagagatagatagttaaaaaacaatcaagaaaaagtagccagataagtaggtgaagaactgcttgacaatcaaggaaagattggtgaattaggtaatattcatttgcataaaatgttgcccagtggtcaggtaggcgaaaagctgaatataggcagttagattttaccatttttatgtttctatcccctgctacctgactaaactattttcaaaatgtattttatagcttagagccttcccaaaattcctagtattatatataaatttccaatacatattgatagctgaacaatcatattttcctggggtttattttaataatatatgcatttattttagccaatgatattcacaaagctttgctgaaatgtgttttgtttaacttggttctgtatatttttccatgaaaagccatactaaaaggacattttccaagtattaaaaaaaaaagcaaaaaaccctgcagtccagaatgcataatttgttctgggatagttaaaattctaagagaagtcttctttgttctttccttgctctttctttgttctccaaaagggtcgtatttaaactatgggtcatttctcatctgaatagccagggaagattagctacattgctactgatgcacttgatattttctcattacataacatgtggccacagattctagccagtctgataagataaaatgttcataatacttagaagataaaagggaatcatcactacttaagatccctttaaatccaatctgttgatctgtatgagattacatttttggctctcatttactagttccccctaaagaaagtcttgatatagctactgggttcctggcttgtattttgatagtcaaaacggcagtctggatatttttctactcagtagatacaatagaagaccaaagcttcttgcattgtagtcactgaccttgccatgtcatttcatattttctgtagatttggtcctggaaaatcaaatattaagcaagtttgacagttcagctaaattccataaggtcatctatcacattacatacagtaattgattttacgttaattggtctttagtttcatggttcatgtttctggttttctggtagtttccagaaactttcgtgttaaatgaagagctatgctatgtaaataaaattcagtaaaacttccctttcattttaattatgtgcttttgaaaactaattttattgggttctttaaaaaactccgtaggagtcaggcatgaattttctactctttagggcatttcaatcatgaaagaaagaaccatctatatttttcatcatctcaaaacaattttagaccactactatttgtaggtacaaataatgttcattgatttgctttatatttattaatcacctaatagttatgaaatggtgccctaagtactgtgactaaaaaataaatattagtaagttaattttactaatttttatccttaggagctttaatttatgctagataatatctgagaaaaagtcaatagtatgatgctgtttaaagaaagaaagcaactgctatcctgtgttgttgtattagcagaattgtcaaggataaaataaataaggtgaagattagactccacttggcaatctttagcccttgattggagtaccatgttccatttgggaaggcacacttattacaacatagacaagtttggcagaggtttcaaaagaaagcaacaaaaaaatgatgaagggccttgaaaatggggcctgtaagaaaaggctgagagacgtgagaatgttcaatcttgaggaaaaaaggcagaggggacacatgataactgtttacagatgcgtaaagaggtgttatggagagaagagggacctatttttctcattagtcaacaaagacacttcaagaagtaatgggtttaaaacacgtggggggaaattcaggttaattattagattaagttaggtaaaatttaaatatttaaaatgttatgattccaagcataattaggctgtggagactaaatcacattagaattggcataggaaagtgagatgaaaacaaattcaatctgaatgcagagggttaattattgcaagtttatatttgcattaaatgttatcatatttcaaaatactttcacatatattgttttactgatctctggacattcttaggaaagagagagtgtatcagctagttttacagctgagaaaatggaatttcagagaggcaaaatgttgcttcgaacccccacactccagattagatagacaaaactgctaagtgcataggattagacaagcaggactaaaagccaactcttcacattttctgtcaatatgtttcacatggtaccttgctatcttttcatttgtaatatgatttctattgtggagaaatattgtttacatagaggaacaagaaacatgattgaacttatatctgcattacctatatctattatttatctctcactactcacaattgtgaaataaactcagcactttggtattatattttgacaaatcattgccaaacgtaatacaatctccagttggtatgatgtggtgagaccctaccttctaccattacctagaggtggagacacatttcatcttttatgaatttcatattcctcatctgtaggaagaaaattataatatcttctggtttcttctagttttacaataaggagtgaatgagaaaatacctgtagaagtacctgaacttgttcaaagaaataaacttgttcaaagcataaactttgcttggggggaaatgtgtgttgtttttggtgtactgtggattttgataatccctttccagttttattttcaatcctaccttttttttttttttcatttcctaatttcagattcctgaggtcaaggccaatgtctttgttgaagcacttaaaatttgctagtctaatgtaggtgttcagtaatagttggtgggtgactgagttaacaaatggatgaataaatactttcagttggatattatgtctgggatatgagcaagaggtgataaatgccatatataatcatcttgttatactcctttatgtaatgatgtatgtttaaagtattttatagaaacatggtatgccagattctcagttagatcctgagaatacaagccactcaaagtctaaaggggttttgcagaccactccaatgctaggtatagacaaaactcttcccagcaaagcaaggtagctgatgccaaaatgttaccaaggaaagacccattggttggttgccaagacccttatggagtctgagaagatgttttagactccctcaaccatgcacacaaattgtgtaaagtaatccaggaggcagcctaaatggaaaggctgttagtatgctgagcttgctaggaaatggaggaattttacggaaaatgtcagcctctgtagactcctgtgatgctcgctagggtgccagccttccccagggagcccacagcacctggcaggcagactgcagcagggagtctcactgggaggatacaaaagagcttaatggccccctgtgcataatgttgaaagaggctgcaatttttgttttcttcggagattaacgtgtgtgtattgcaggttcaaaatggtaagaatcttaattagagttgcaggaagttgcataatatactccatgtcttactttttccgcacaccaaataacagaatctatttgccaaattatgaaggttgatggagaatgaaaactgtaatttgagtaaatgggagccctgcccccattttttccagttagtcacaaagtttaaaatgcaaagaagtaaatctcccaagggagcaattctatttcatctgtggaagaaagacatatgttgttactgatgaaacctctgttgtgaaagcagagccaatgctgggaaaaacttgaaggaaaaactagctgagagccctctgtctcaggagcctgtggcctttgggtccacccagggctgcctgtgcctcttcctgaggcttttcttgaaggcctgctctttcctctgattaccttagggcaattgcctgcctctcttaagagaaaatgtacctgttttgtgccacatcccttcaggcccctgagctggacagtagattgatctgacagatgtcactttgatattaaatcaatagtaccaatatgtttctgggttttcctggccttagcaaggttttatgttcacttacttagagacattctggagaatatctcagaactcaaaacatgagatcaaattggagttctatgggagagaggatattgaattacttggctttattatggctgcactcatagggccagccacgtgtaaaagtttcattctctttttttgaacaaatatttattgaaaacaataaattaccaagaactgtgttaaaatatacagatgtctaagcagacacggcacaatctatggccctaagaagtctaggaggtacaatattttatataaattattcatcttcattcaaagttatttattgagcatctactatgtgccgtgcactgtgcatgcccctggaaagcataagagacaaaattcctttctttgtgggagctgtattctagtgaggttcagcaggtgaacagcaatccgtgttaattatttcttcttccactgaaatgaaaattctatgtttctaaaaaatattataaaagtactcttcaaacctcatattaagaaagtcaaattgtctttagccacatttgataaggattaaagataatcttactattttattttaaacatatttagagcagtccttgtctgaaggaagcttgtgttgaattttttataaagtgagttaattaccttctaattaattttgtgtgtgtgtagtgctcacctaacacaagattttcatgctgaatttgctcccccaaaagaaaaacaattcctatatatgttgtaaagggtcgcaagtcagaactgagatggaggcaatacaaatatataaccagcggcctcagacaagttcccaaaattgggaagaatgaagagatagggaatgactgcagagcctttttcaggaaagcatgagattggaagatgaatgctcaagtaaattagaactcaggaaaagtactgaacagcaggatcatatcatcaaaaatctggctgataggttttgaactcactgaactgaatctatttagaagtacattttgggaagactaaataaacatcaacactatggtctattctaattcaggctcttgctttgtctattttccaggtgataaaacactgattgttattagtgttatcatcaagcatattgagcagtcaatctgtaagttaatagcaatacacagccatatagtcctggaactagaaggaaagaaaatgaattttttcttttttttttttctttttttttctgtagaggggaagaaaaattcaacaccttgagtcagctgcgactcaagggtccattataacttcgagatttttaacagcctgtgcctagggtatgggagatgaattttgttccaaagtggtgacatgggcagatataaacccctgggagcaatttcaggcaagttgagagtccattctaaacaaaaatggacagaatgtggaagatggaattcccacacttgctttctgaccttggctgatattcctcagcagttggtaattagaggaaatactgaagctgagaggatgaaagaataaagaagagtagaataatcagaattgaaagaatgtaaataagtaataagatggggcaaaaacaggaatggtgtcactgacaaaggtggccacactttgcagtaagatgtgagtgggacatagaaactagatttggttgagtaagaggaaaaccatatatacacacacatatatatacacacacacacacacacacacacattaatatatgcatatttaaaaatatatacatttcaaaagctcatttatgttgaatactaagtgggaaattcatcagctgtttggcttcctgtctgttttattctttgccattgcagacttgagttgtcttcctgaaatctttctgggagataactgcatgcccagcccttttctttcatcagaaaaagggtattctgccctgagtcagaagcagggggaaaatagatgataatatctacatgttattgctagaacagagtcaaataaaaattaaaagtccatcaagtgatcaggttgaagtcaataaaaaggtcaataaaaagcaaggatgagccaaaaaagaggacttggtgtactggaaaatgccaggaaaaataaaagacagaaaaaacactgtggcaagatcttctcctgtggcctcagggaagtgcatgataaaattaattgaagcttatcacccatgaaaaagggctacagttggagcaatagctgcacggactacataacagtacaggttctttagcctaagacaaagataacagatttttgttttacttttgcaagcttttttaatatactgagttaaaactctctttttttgcctttattcaactgaatgctgcattttttgagcaatactaagtgttgattggcttacttgaacagcaatttgttaagaggcctgctgtgtaccggccattatcctaaataccagtgtacaaagattagtgatgtgtctatctgctttcaaaactcttataatctgtagcaacatgagattaatttttacatatggtttatatataacaatctaattccaatacaatcatatcattctccatatctcataagaaattgttttgggacattatttaaagaaaactttatacaataaatctataaattgttagtagatttgactcctcctttagatgaaagttttcatcttgtcgtttttttaaattcaaaatatgttattttaagttgatataaaacaatcatattagcaaaatgcatccacattgaaaacttagctggatgggtaaagatcgctctattaaactgtgatgtttaatactgagtgtcaacttgattggatttaaggatacaaagtactgatcctgggtgtgtctgtgagggtgttgccaaaggagattaatatttgagtcagtgggctgagaaagccagaccgacccttaatctgggtgggcacaatcaaatcagctgccggtttggctagaatataagcaggcagaaaaaggtgaaaagagagactggcctagcctcccagcctgcatctttctcctgggctggatgctttctgcccttgaatattggactccaagttcttcagttttgggacttggactggctctccttgctcctcggtctgcaggcggcctgttgggaaccctgtgatcatgagttaataaactcttttacatgatattctcatgatagtgaataaatttcatgagatctgatgggtttatcacgggtttctgcttttgcttcctcctcatttttcacttgctgccaccacgtaagaagtgcctttcacctcccaccatgattctgaggcctccccagccatgtagtactgtaagtccaattaaatctctttttattcccagttttgggtatgtctttatcagcagcgtgaaaacaaactaatacaggcactgttccatctccaaatggtcataatttatcagttcaaaggaacgtactttgcatgccaccaaagggttttctaagaattgggtcagcaattttaagtcaaggttgttggttctgagttgtacctttgagtcagtctttcagcattttagttctcaaatctagttttctactctttccaatggggttattcatccaatagacatgggaaaatcatcctaatcaaaacaaatttatgatcatttctctctggcatgactgcatcaggtagcttaaaccatagaagtttattgtctcacaattctgaaggctagaagttcgagaaaaagatatcagcaggattgatatcttctgaggggctgtgaggaagaatctgttccatggttcacccagcttctggtggtttgctggcaatctttgatgttccttttgcagtgtcaccccattctctgccttcgttgtcacatggcattttctttgcatgcacatctgtctcttcatatggtgtttcttttataaagacaccagtcatactacagtagggcctcaccctaccccattgtgacttcattttaatttattacatctgcaaaatccctatttccaaataaggtcatattctgaggtatgagtgggttggactacagcatatgaattttggggagacataattcaatccattataatcatactgcataactgacgagaaagtaaagaatcaatctgatgcaggaaagataacctaatcaaaaagaggaattaaacaactccaactaattccttacatttaatctatttaatataaaattataattttgcaaacacagcatggtgcactatggtaactaaagcaattggatgatatttcaaaagctttaataactagtatttaatcacagatgctgtgtgtttttacctgaaattcatcctggtaatgcaacataattaattgcacaatttattttagcatgagttttcttatatttatagagatagcatagcaatcttgttttcaaatttccctcagaatgcttgagatcagacattattagcatggagacaatagtttcattgtcaactcctgctggtttgggtacatttacagtaataaccacaatccactagcttgaattattgttcaacattctatgtgacttcatgagggtattaatatgcaagagagttatttgatactaatcaaagatacacatttgtcttcacacttattacaatatggtaaggtaatcacataaaatacttaagatggtagacttcatacatatatatatatatacttttaatgaatatactaaagctaaccgttaatggaagctttgacagaaactcattgttcaatatccaagcaaatcaattttggactataaatgcagaattctaacaagcaaaaattctaatcattcattttatttttctgttattcgtggcttcttatattgttaaggcttaacatattaagatgcacataggatttaatcttcatgagagagcaatgaatacatcattgaatacataccaatcatgtgtaattgttttcatatgtatgtaagcccagcggaaaagagtcgttcattgacagtactcattttcccatttggtgtattttcctaattgtacagtataacagttatagtaaatggttataaatattaccctttagctgtaacatctatgacatttttgttgatcatgataatatgtgattgtttagtcaactgagtttattgtaattgagattggaaatcactataagagtgaaattgaatatatagatagagaaataggataagttaatatggcagctcaacactgaacacagactacaacttcttgaccaccgaaatatgcaaaatattatataatagcttgtatctggacagcgtgctaagctgttcacttgttctttatcatttaatcctcttttcaaatatgtgagatatgttctgagaagataagcaccttgttgagtcatacaggtaatacattttaaaggaggaatttatatacacttaagattgtgtgtgtgtgtgtgtgtgtgtgtatgtgtgtgtgtgagagagagagagagagagagagagagagagagtttcaggctccaagacagatattaatggtagactgcctttgttgcataactgtagcagtggtgtacaactgctactcccatcttctcagtacttcatctctttctttgaatcaactacagctattctgatggctagattatgatctgccagtttgagaatccaactcttgctggccagagacttacagttaaaaaataaatcatttagagtcatatgcttatgtactactgggctgtgatcctcaccctaaagctcactttggcatagctctttacttgccatcgattcttgacagccttatttcagaattcttacagacacagtgtctatttaattttaatacaatcaagcaatggtttctggacatatttggctatttctttgaaaacaatggaatctgtcttatgggcaaaatgacttttttctgccctaaatgctgacactgaattgcgttcaatcatgacagaatttgtgcaatatgaaaagtttgtccactgggtggacaatttctatctagcatttttctctccttcagggatggactttaagttgatttgacaaaattggtttcatatgaacccaaatgcaaaccctatattatctttaaacactggtttctgtgaagttgtttgattaaactaatactgttgactccctgttttctgttttatttctttaagatgacatcccttattctgttctgctacctgggacattgctcttctctccatattaattaattaatattgtttcctaaatctgtcttcctagtctctgtgtttgtcttcaccatgtgtattgggatatattctcgaagggtttcatgtgtgaattccctcttgagtcaaattgtacatgtaatttcccttcattttaaaaataaataagaaatatgagaagaattttcaaaacttttatgttctatatgctttcctctggtttggaaattaatctctgaatttatttatattttaggtattgcaatttgagaattagaagagttgtttttacaaaacacagaaaacagcttttgttttaattatttttcccagtgtgtctaagagtcaaaaagactctgtattagtattcactggcaaacagaacacaatgcagagcagatatcctagaagcaacatgatagatccaatcatccgattcattatagtacaaatattgtaatcaatcataatattcagtgttccataaatccacaattctgtgaaagggataagaaaaaagaaattaagctatcagtgagtttactaaaaaaggaaaagagatttcctgattatcatcattcagaattagtcagacatatacatggtaatcattcatattttaagcaataaaaggaaactcaacacaaagcctggaaagcaacagccttttatttttattttctctaagatgtgaaaaaatagacctaggtgctaatttaattcccttttaagttaatgacataatgggtttgtggagcattaaatagggaataaatatggccttacatttccatgtcggagctaaatgctttctcttccctcagcttctaattcctcagctgagggaagtgatcagcagtcaacgatcacaatgagggagctacgcacacatcctctggtttcctgagctttggaacacttaatgcttagtgcagcttctctattttgagttctaccatgaacccctctctgatgactcccacatatgtcttttttatgtaagcacaccaagttcagctatccctgtaggtagacagcatttgagacttctcagttgggtatgatttgagaagataatggagctgatcctcttgacataaactagcctattggtcctgcccaaactggtgttccctggaacagaggcctaaaaacaaaatatatttaaaatgttcaaatatatttagaaaatattgtgttaaatcaagttagccagatttttgttgctttcattgtcatttttgttaatattgttgcatgatttccagaatattcagtatgcaaataaatattcattatgaatttaacaaaataggtattttctaaacttctttgaccttggaactcttgttctcccttcccaaccccaccattgcacttattttaacattgcactcagcagggctatacgcatcaacattttgggaatttgaggatgaagatatgtttttcctattaaaaatgaattcttatcccactgggaaagaaaacacattaagcttttatcagtctttaacattttaacatggattagccattctgctctttctggattataagcagctgagagcaggctttcattatagggagagggaaagatgatctgaagtgtcatgtgtccccagagaggattttcaagtggaatgccaccatgagagttcctgggctagcagaggacaacttcatatagtgcagggttgcagcaaggccactgacaccagctgtatatagaaagttatgtttgcctcagtttcttcagccaaaacagaggaaatttactagatagtagctatctccctcttagctctaacaatacaatctgattatcttgatggctaagtgtgggaactgagagagttagaagagtgggggtcactagttgaaaaagcaaggttagaaatgaatgttttctcagtcatggctggcctagggctggctctgcaggagttcatgattctcatctccccaaacaacaaagagccatggaaaattcatcagataacagtaattcaacagataacagtataaagactatacatatttttaagatagatttaaaaaatgcatgacatatttctggcctccaatgagtgttcagtatgaaaaaataccaactagatgaataagtataggcaagcaaaagattctaagtataagaaagtgtgaaaagtaaaatttattttatttttctttgaaagagcagtcttcccaggtcaagagattagaaagacaagtaaggtaatgcctcttctctgaagtttagaacagatgaaagtgacacataaaagcagaataagataaatattatatcatagtaaaaggaatgagaggttgtatgtagagtggttgtggacttggactcaagagcatgtggacacaaatttctaggttaaattccctggattcagaacccatttctaccatcttactaggtctgtgtcctcttgtgtaaatggtagtggtgatgataattaccatgcctttctgctagaactattattaggaggattaaagaaaattaatatgtataaagcatctagaagagtgcctcacataaaataacaaacataagtatttactatcattaataataaattatatccaactagaatcattataaggggttttagaaaagaagtagcaataagataataagtgaagaatgagtaaatttttgaagctacaaatggattgaacatagtactctagggagagggacaatcatgaatgaatacatcaagatgaaaagtcaaagggtaaattttagaaatagcaaatagattggtttgctaatataacatactggccctttactgatcatgttgatcattttgtgagaaaacagtaggaaatgacttcagaaagaatatagtttggtaaaaaccattttaactgtaggagaatgaaactggattctcatctctcaccttatacaaatatcaactcaagatggatcaaggacttaaatcaaagatctgaactaaaaattctagaagataacattggaaaaacccttctaggcattggtttaggcaaggatttcatgaccaagagctcagaagcaaatgcagtaaaaacaaagataaatagatggaacttaaccaaactaaagagcttttgcacagcaaaaggaatagccagcagaacaaacagaaaacccacagagtgggataaaatcttcaaaatctatccatctgacaaaggactaatatccagaacctacaacaaagtcaaacaaattagcaagaaaaaaatgaacaatcccatcaaaaagtgggctaaggacataaatagacagatctcaaaagaggatatacagtggccaacagacatattaaaaacatgctcaacatcgctaatgatagagaaatgcaaatcaaaaccacgacacagtaccaccttactcctgcaagaatggccataatcaaaaaaataaaaaaataatagatgttgaagtcgatgaggtgaacagggagcatttcttcaccgctagtgagaatgtaaactagtacaaccactatggaaaacagtgtggagattccttacagaactaaaactaccattagatccaggaatctcactcctgggcatctacccagaggaaaagaagttattatatgaaaaagatacttgcacacacatgtttatagcggcacaaatcacaattgcaaaaatatggaatcaacccaaatgcccttcaatcaatgtgtggaaaaagaaaccactgtatatatatatacgtgatatatattgcatatatatatgtgtgtatatgtatagtatagatatatgtatatatatagtatatatacacatgatatataatgtgtattatatattatatattatatataatatatataaatatatattttatatatataaatatatatgatggaatactactcagccatacaaaggaattagttaatagcattcacagtgacctggatgagattggagattattatcctaagtgaagcaactcaggaatggaaaaccaaacatcatatatgctcactcaaaagtgggagctaagttatgataatgcaaaggcataagaataacacaatggactttggtgactcagggggaaagggtgggaaggcagtgagggataaaagactacaaatagggtacagtttatactgcttgggtgatgggtgcaccaaaatttcacaaatcaccactaaagaacttactcatgtaaccaaacaccacctgtgcccagtaacccgtggaaataaaaaataaaagaaatttttgcccaaaccaatgtcctggagtgtttctccagtgttttcttctagtagtttcatactttctggtcttacatttgagtctttaacctatttaaatttgatttttgtttatggcaagagatagcattctagttttattcttctgcatatgtatatccagttttcccagcatcatttattaatgagactgtattctccctaaggtatgttgttcacacttttgtcaaaactgcattggctgtaaatatgcagatttatttctgggttctttattctgttcttttggtctatgtgtctgtttttatgccagtaccatgttgttttggttactatagctgtgtagtataatttgaagtcaggtaatgtgatgcttccagctttgttattttttgctcaggatgtcttggactgttctaggtctttcgtggttccatatacattttaggattttttttcgatttttataaagaacttcattagtatttcgatagggattgcattgaatctataaattactttgggtagtatggacattttagcagttactgattcttttaatacatgaacatagaaaatgtttttatttttcatatctttttcaatttctttcatcaatgttgtattgtttttattttagagatttttcacttctttagtttattccaggtattttattttatttgtggcgattacaaatgggattactttaattatttctttttcagattgtttgctgttagcatacagaaatgctactgatttgagggaaactcttctacactgttggtgggaatgcaaattagtatagccgctacgaagaacagtgcagaagttccttaaaaaagcaaaaacagaatggccatatgacccagcaatcccactgctgggtatttatccaaaagaaaaacatcagtatatcaaagagatatttacactctcatgtttatttcaacactagtcataatagccaagatatggagtcaaactaagtgtccatcaatggatgaatgaataaagaaaatgtggtacatattcatgatgaaatattcagccattaaaaaagaataaaatccagtcgtttgcagcagcttggatagaactgaaggacattatgttaagtgaaataagctaggcacagaaagacacatattgcatgttctccctcataggtgagaactaaaaaaattgatctcatggagacagagagtataatgatagttatcagagcctggggaaggaaatggggagggggataaagaagtgttcggtaatgggtaatgggaacggaagtacaattagatagaaggaataggatctaatgtttggtaacaaaatagtgtgactataattaacaataatttattgtatatttgaaaataactagaagagtggaattggagtgttcccaacacaaagaaatgatgcttgcttggggtgatgcatatcccaattatcctgatttgatcattatacattgtatgcatttgtcaaaatttcacgtgtggcccataaatatctacaactattaagtaaccatgaaaattaaaaattttacaatttaagaaaagttaacttgacgagaaaaagaatacagtttggaagtcttcgaggatagataggaagagattttccatttaatttggttttaaatgggatcttgtctatgtttgctcagggtaatcatatgaaaggcattataatttgaaagcttaatctcaaaatagtactttttttggtaaccagttgtcttgcagcaaaaacaaaagcactgaacttgggtcaaaatacgtgaattcaaatccatactttataccttcagaatcaaacactctaagcctcattgcgttactctttaaaataaggaaagtgcatctaaattacacattgtttttagtagcaaataagttagatgaaaaagcatcaaatgtaatgttgggcatacataaattttcaatcaacttttaactatataatattatctgaacaagacaagtgaagaatacaattgtaattttttaaattgcaaggcaacagtttctaccctaataatatctacattttcctcataaaagtcagtgcatcagattctatacagtatgctcttcaaattcttggctccaaagttagcaaattaaacatcccatctcatttctagtttgcagtgaaattctcaaaaagtttccagaatccctgatgttactcatcctgagctacatctgacttctaatcagcatcttttacttagaatacagatagcaaatctggttggcagttattttccaatgattcttctgccatactgatgctttataatggctccaaggaaaggccattctacaaataaaagcaaaattaataaaagaatgcgggataattgacagttttgctacaacagcatttaatttgaatcctttgaaacttactcttcactcattgatttttaggctcacaaattctttgtgtgaattctctcttttacttttgcattgtgaaatgatttatcatttgggtaattttccagaattacactttattattttgtaaatggcatgcagcacagatggatattagcaaggtctctgtataaacgccagcaatagaggtggtaacattgccctgagagttttctcctgaaacaaatcaaataaagaagagaaagcattgccaaagctggccatgacagaggaagtggatccaataatagacatctcgatggatacatatatatgattcaatattgtgtgacctttactttcaaactcactttcagaaaatatattctaaaggggtgccaaggatattgctgtctactctctactgacttccatgaaaggaaacaccattcctctgtatctcagtcatcaatgagtacatttatgaaagagtttggccattgtcaattctaatgccgttaagaagaacttgagcatagcttacatttttttcctcattttactcctacttgtatattgctttggcatatactattagtgcaatgctgtgacttccaaaacttctcagaaagtaacaacttggactgttaagagactccagcatttgaaatatattttaatgcaaactgtctccctgaagacctctatccatagctaagatagttgtatccgaaagctttgcgcttacttctttgcagtgctatttgtaaacattggcatagtaagagtgataaatttctatggaatcatctttatcaaacatacattatagaagtagaacttattccagctaaccacattatcatgaatagcattttccatatttctttgaaacaatacaatagaaacaatattatcttaaacattaagtatccccattgattggtccagtgaaatactgcttggaatgaaggcttcaactttaaatctatttaatcaaatttggtaaaacaatcatggatcaaatatattattaatgttacgtggcttttattattattattattattgcaaaaattaggagccttggtttttgtggccttattctatttcagttagatataatatctcctggccttgggtgctttttacatacaaatggggtaaaatagttattataaagaatagagattgaatagatgtgcttagagtaatgtctgacacaaagcaagcactcggcccagcacagtggctcatgcctgtaatcccagcactttgggaggccaaggcaggcagatcacgaggtcaggagttcaagaccagcctggccagcatggtgaaatgctgtctctactaaaaatacaaaaaattagccaggcatagtgccatgcacctgtaatcccagttacccgggaggctgatacaggaaaattgcttgaacttgggaggtggaggtagcactgagctgagatcccgccattgcactccaacctgggtgacagagcaagacctcatctcaaaaaaaacaaaaacaaaacaacaacaacaaaaaaagcaacggctgttaattgccaggaagaagagctcctacaattgtttcatgtgcatttaggcactctcttccatgtgagaccccaagcagtcagcaggactatcaaaggaacccttttaagacttagatatctatttttaattcttgcactgcatttctactttgataaggggaaaaggcattaaaacacatttttgaaatgtaaatttccaaagttacaaaaattaacccaacacatcatatgctctttgaatcacttaaattggcagctgtcttataatgataaaagacctacggcgttcttagatgatgtctacatgatgccagacagctaattgaattaaggaattaaggaagatatcaactagtccttccccttatttgccagatgaagaaatggaggccaagaaatgtgtagtgatttatttacatcaggggttgagtctgttggtcgtgagaacttctagcctagttattttttccaccccatctatctgtcctgaaatttggtttcttattgctgcagcattgaagagatggaaccactaaaaaaatactgataaaaagatgtttatccagaggcaactttaatggcaactcaaactatttgaaatatgatggaaaatttgttactgagtgaaaaggccatcgcacaatcaaaattgatgtttaaagctcgcctactaactcttccacactatccaatgtagtggtcctccttcattttgctctttagagtttccctaattttctttatgcatgcatctgatttcatcttactttagagaaaatactaacagtgtatgtctagaacatggcagattggagccttatagcacgagaggcagggaaaagacagctaatagcgattcactgataggagaagaaggggtcccatattgtttgagttttagataacgtttaatgatcttcctggataacagattctatgaggattttttttttttgcttgtttaaataaaagctgattcaatgataacaaaaggagagacagtaacttcagaaaaatatagatatgctaattcttacatttgtagagcccttttgatattaaggttcaagatctaaaaatgtaattctcattcaagaccgtataaaaattgttagttctatataagcatattgaatcactgatagattaaagcacattcatcatactctagaaaacaaggaaatgtgtaatatatttgatgtcatttttattacaattgttaaaatagtgaagaataaacctgttaactagaaatctatgcatgcagaatgtcttattacctaaataacaccagataaatgaggtgttactgtccacagtctcacaacagagacatgaaaaacccttctttacactggtaacccttaattaaactgaatttttggtgtgtcccttcaggagaaggtcaccatatcagcaataattaggggaaatggcattgtgaacattactggatgagatgtggtgtatttcttactttcaattattgcctccttgtttgaatcattagcatttggcagatttgttgctgaatttgttgttctgatttaaaactcggtgtaaggttgaatatgttcttatcttgatcttatatttctgccatgacttgcatttcttgctgagtttctgacttgaattgctctatgtttttgctgagcttttgctttgtcttgttgtatttctatctggaggggtttccctccgcctttttctttttgttatatctcttctttggcctattgtatttctctggcccattcattagctttttttttcctttaaagttattctcttgttcagtatatgcagtacctaatcaatacgcttccttgcttgctgcaggatttccaacttactgtgttttctgtcagctttgatactgcctgagaggggtttctgtgctttggctaatatattgttgtctgaattcgcagtgttttcagctcattacactgactttaattttgatgtatttgtattttatccagttcaagtcatgtttctttcctctgtcaatttaattactttctgcctgggcaacattgtgtttatacaattgctgctaaagcgacaaaaggtttctatttaaattaccacccagagcatcagcaattcagcctaaaaaatatgcagaactcctctgattgatgtcttacctttctgtggataaggaaatctagtctattgagaggatcttctttatagaacatagtcaagcctggtttatagctgtagagtcattaacagaggagatgagtgtagggctatggggtcactgtatgacttctctgtaagaaaaaaatgtatgactaggttctattcagtacaagtcatgtcctaacagcaggaaaaagaaaactttcttaggtgtttaacttatatttaggtgggctacccaagctccagctcttatttttctatgtgttatatatattatacacatttctgggtttgaatcttgttctttctaataattttgcattgggctgtgtaagtcaggaacattgaatttccattgtgtacataaaactatagcaactggtctaaaaacaaataatgtgggaaacatagtaactgttcctgttttcaaaggcttacaataatgcgaaaaaaagggaaaagcttatgagcaatacatctttgaaaacagaaacagtgaaaacactccagtaaatacataattggttattaatagaattttaaattggagaggcataacaattgcaacagctcttggaaatgcttaggaaactgaggcttataggtttacccgaacatatgtcatagataacattaatcaactagctgatgaacatgaccagcaaatgcattgattgcctgatcagcaaatgcttcaactgttttgttttacaagacttaatatgtttaaacaacaacttactctttacctactttttaaaaatatccttctgtattttctgcaacaaaccattgttgagtccctgtgcttaacaaaactgtgcaactgtgctatttacccagaggaagaagaaagatttttttaagtcagttcttttctggtaagtgtaacttttctagtattggataatctttctgagcctcagttttcttatctgtataattggcataaatgaaccatgagaaacaaataaaatgacatattcagctcagtgtgtgtcacatggtgagagacccattaagtttgctcttttccttttgcctttctcttttcagtgttcagtcattatactgtcaaataaattggagtttctggcttttctcacactcaagattattatgatatactacactagtacatctgaccttgataaaaagcaattttctatagtttaattgtatagcaataggatgggaaagtctctgattctcactctgtagcttcttcttcccagggctggagtcatttaatctctacctttaggctcattctaccctggtcccttgggtcatgaattcatctggaagattcagacttatgctttaaggctctcagaaactcaatcttgcagaagaatctggcctccattttgtacacactttgttcaaagagcctcctagcaccttcccaagacccacatataccactcccattttctctcttggttctggtgattgactctctttatgttcttggaaagctgcctagtatcctaaaaccagtattgctgcctggctgttaccaggctgcaccctcgactaaagttgatcccctgcactcatctttggactctagatttctattacatgcacatcccttgtgccaaattatgctggcttgtctggccttccaagtttcacctattgttatgcttatttgtcagttcaagtctctattccagctctatcccacttccttctttctttagcctgtgtccctctcttggatccctgaaacattttgagtactagctactcctatgtcctgcccatgtgattaagaatgatacttttctcccgtgcttgcagctgggtagtcatactccatacccacccaggtaaaaatgtctggatccaaatctacctttcataacagatctgatgtgctattctagacagctttactccatgatatattgcagactttatgtaggttaacaaagcattatggtgtcattcttgtgacagccctacattttcattatgatttttgtgtttgcggtcctttttgtgacaatttcttttagatgaaaatgcttttaatgaagcccttttggtacttgggagcctcactggaatggatttagtacaaacttgccttatttcaaatttatgttcaatattgaacaacactgttacccatatttaggacagtagacaggtaaaggttgcagaatttttatgaaatataaagcaatatccactgttataatgaagcactacataaaattgtataatacgtgagtttcttattcctcaaatagtctaactgattgttcattgggctcactcagccaaaagtagagggaaactttgtacagacatcattagtttttctccatttagagattaatcatgaagagctctggctctttaattctgtaatttgtatatttaatgggctgctgcagaatctatgacagtaattagcatagcctgaaaactcattaatacgcaacaacatgattaatgcagcattaatgcaaacatgactgaagttatttgggttatgtagtaagaagattaaagctaaaatgtcctgtttgttttaccagtggtgagtataatagagtggcaaaaaaataaaataaaaacaggtatcaaattagctgtttaaaaaaaagaaaaaaaccagcaaaatttaaatcaaggtgattttatttttcccttaggtctaaaatttgggatataagttatgttctttacttttatatttattcatttattcataaatttatcattactgaaggaaagttcattcaaccttttagtttaacatagttaaccttttagcagctttaacataatattattagtcttacattggaaacaattttaaattgtactaatctttgaccaatacattacacatttctgttttgaaactaatatatattattggctatgccaaataattaaaggatttgttcctacttattcagaagttacatattatgccctcttctcactgtgttcacctcttaaataaatgttcaaatactttataaaatactaccataaaactcatttttttaaacaaaactatcaaatatgacatgttaaatactgaaataatcaataatgtttggggatgtaaaagtatataagttttgcttgttcttgctgtctcatgtaatcatattgaagtcctctcattcttacttttttttggcttttcttttttgagacggagtctcactgtgtcgcccagactgcagtgcagtggcgccatctcggctcactgcaatctccacctcccgggttcaagcgattctcctgctcagcttcctgagtagttgggactacaggtgcccgccaccatgcccggctaatttttgtatttttagtggagacgaggccgggtgcggtggctcgcccttgtggtcctagcactttgggaggccgaggcgggtggatcatgaggtcaggagttcgagaccagcctggccaagatggtgaaaccccgtctctgctaacaatgcaagagattagctgggcgctgtggcgggagcctgtagtcccagctactcgggaggctgaggcaggagaatggcgtgaacccgggaggcggagcttgcagtgagctgagatcgcgccattgcactccagcctgggtgacagagcgagactccatcgctaaataaataaataaatacataaataatacagacggggtttcaccgtgttggccaggctggcctcaatctcctgacctcagatgatccatccaccttggcctcccaaagtgatgggattacaggcgtgagccacagtgcccagccattttttttttttttttttttttttttttttttgctatttagtatgacctgttttaatagcggtcctaaactttaaatgacttatttttcaatcttatagtcaaatgtcaagagtcattaatagtatctcaaacaaaacttgcattttaaggttaagcaatcctggatgactgaaaaaaatatgtatctgcttttttgtacttattttattctaaatccacattagaaaaatgtttatgattttattctttttcaataaaaaaaaacaagtgaatatccacgaagtacctgactcttggctaggtgttgaggaggaaaagcaaacccatcaatgtctgtgcacttggaaataaccatctgggagaagagaagctcctttcaacctagggatgtctatagataagaatgaaattgcaccatagaaagaaagcatatcaacattgcctgctaccaacagatggcactgttaatggtttgtatcacaactgtatttgtgggaccaatagatttgctaacattctcagaaggtagtctggaaggagaagagcctctgttaaggcagtgaaatgatatacatgctcaattttgtttaattatcttgtcaaaattcctggaaaaaaataaaaaaatatatttatatgggatatttcgtttaattaaaatacatcatcttttaccaaaattaatatatgtgaaattaaattgtagtagaactttaaaacaacatagagttcctattgctttgaataattggtctttacatttagtattatattatatgttatattgttatgtataccatatatataatgttatattatatactgtaatattagagtagcaactgatactcacaaagctaaacaactcagttccactgaaatataccagattttgacttagttttaaaagggaggacctagaaacagagagaaaatgcatcagtgggtaaaatcatttacctctaatgttttatttcacctctatggtttttagtgtactagagagctgtttaatcagaccattaccaaattgaataaatggctacttagtgattactgaactatttagtgatggggttggggagaactccttttttaaaaataagccttttgaatagttcatataagaccatcctaataaataaaatggaacagaatgtgtttgccatgtaatagcttagtgatttttaatttctgtattgtgatgaaacaaccagcttttctagaatgtagccagtcctttgtttctcagaagctgtgcacacttgcggcattcagtcctagtgctgccataacagagtttctaaacactagttcagaaatgagacatttttgtttagtctctgtttgggcacagccaagagtttaagactgtacatggagagaaacttgcttttttctgtggatgtaatccaggggacctgttgaggtctttaatgggtggctgacaggatgaactgggcattcaatattaaagggtggtatcatagcaagggggttaccccagcagagtttgtagatcaggaattgtttagagcctagatcttgggaaagtgaacaagaagcatgttaactaaagataaaaaacagaaaccaggtattgtctttttaaactctgagctcttggagtggcgatcatgtcttttccatattagtatctccagtgatgagcattgtctgttggagacactcaatatacatttcttgaatagagtaaggatttactggactttgacacagaactaaggttctgtgtgatagaggtctgtgtgcttatgagaagctggactgtgtaggtgaggatgctaaggctcctgttcccatagagaagtccttgagatggctcaagctgctggttcccttttttcttggactttgcaggtattcaaggtgtctctagttagaagctttatgttttgtaatgggtaaaaatagtgctaaaatatatagctctttgctatttataccaaattgagggtctctcagaacaaatacagtggacggattttaataataatagctaatacttatatagggccaaatagttctgagtacttttcatgtatttaactcatttaatcctcccaaaagacttgtgaaagaagaaactctcgttgcccacttctagaggaggatattaggtgtagaaaagttaaacgatttgtccaaagttacatataaattaagtgcagaagctagtttttgaaagcttggctctagcatttgttttttaatcattaagccaaacatcaaattccccttcccacactttttttttcacttttaccaaagaaatatcttaacaaaatgactcctttggaggaggaatacatgcatatatatatctgtgtatacatgcatatatatatctatatatgtgtatacatgcatatatatatctgtgtgtgtatatatatatctgtgtatatatatatacatatatatatgtgtgtctgtgtgtgtatgtgtgtctgtgtttctgtgtgtatatgaggtcagagtgagggccaagaagctattttttctctaaagtggttcatatattgcaagtgatttaattgagggaagatatagttgtattagctaaaacacttaaaagtttataaataggtgtgtctacacaaaggcaaacattcctctaatttctaaacagtttttacttctattgaattgaatatgcctaatattttagtgtcctgatgattaaagtatgaggaatgaattaataaccaggttcaaatatgtgtattgttaccatgcagatctgttaatacttattaattcccacatcagtgtgaactaaggaaaatgaaattaagttgcattaagaatgtgctcagttatatataaagatttacttcctgtaagagtgattatataattatatggtttactaaaatagttatgagattttattctttcattcatttgacatgcattattggaatcttagtattttcaaactacgtatttggagataaatattgcagtctgaccataatgatagtttaggtattccttggcctggaaggaggacactagttcattttattaacatgttctttgtctgtggagagcctccacaatgccattttagtaaaatactggatctttactaaaccatggctaccaaagacaaagtgtcattctaggcagccaacagacttcttgccctactcctgacaagcaaaataaaatagcctggggtaagagaggtaatggccatgagttaagtcattttcatagttatgctaaatcagcttccctcaggagcacccccttcctttcctttctctgtttaaatgaggtggagtatgatgtgactattccagcacactcaaaattagatgtgtgatcaagtattgatcttcaggaagttcctaatcctgtctgatgttttctgtgttagctttttttttccttctgtcataatgttagattagccagcaccttcattttgttattcccttactttttaaggcaggattcttctgtacaagaaccctgaagcgaccctaatattgtatccaaaatgtagggtcagaatcaggagtggagactgtgagttcattgtgagttaacagtctattatttaaaagtgcaacaagaaaaatagttttgctttcattccatttctgggactctaattttttccaagggagtctggcataaagtatcgtattggtccaattgcttgggatccactgagattgttactagagagggctttggtgtaaaaccccagagtaaaattctttaatgtccttttgggtcattgaacactttctaccattatgcttgacatggacaccattgaaatcattccaaggtcaaggtcactcagcaattttactaatgcttcaagttagtggaattttatttttccccccataatgcttgttttacaaaataaaatacagtatattttagtagatattgtaagatcaatttttgaaatttcttttatcaaaataaatataaattttatgaagtatctgtatgtttattatatgtaaacgtgcaattacaaatatgaaatataatttatatacatgtatctatgcatgcacctggatcttatttgaggtataaaacatgaaactagaactaatgtgttttacaaatatacgtaaaaagttattatttttttaattttatagaaacacagagtaagtaatgataaaaattcatttgtattaaaaatatttttataactacaattagtactaacattttgctttagcctaagcttaaatgctttatttgctagagtcacttgttaaaatactaaaaattttacaaggtatgaaggtaaaatagaaattatttcaaaaaaacaaaaatgcatgctgaattttctcttttcctttataaaacaagcaagtcctttatgtagatttctacaattcataattcaatgtcattaaatggcattcaatttatattttagactattatgatttcaatttgagacacaattgttttccaaatgaattcaatgtggggtatatttatgtaatagatgaaatgtatttcatctattttggaattgaataaattcaatttattcaattgtttggaattgaataaatacagtacgtataaagggaggatgaaaatgtacaactattggatgttgatagaagcattctgaataagaagcatttttacaataaactcaagtatatttttataatgtactttttaataatacactgattttaaaagtcttttttataatgtactttcatatattttttcttgagaaatcttgatcttgtattgacaattgcataaatatatttgtgcccagcacaatggcttacgcctgtaatcctagcactttgggaagctgaagagggagaattgcttagtccaggagttctagaccagcctgggcactgtggtgagaccctgtttctacaaaaaagtcttttaaaaattagctgggtgtgatggcacatgcttgtagtcccagctactcaggaggctgaggtgggagaattgctgaggattgtttgagttcaggaggtcaatgatgcagtgagctatgatcacgccactacactcaagccttacaacagagaaagaccttgtctcaaacaaaacaaaacaaaacaaaacaaaacaaaacaaaaataaataaatatcttggtatgtaagggcaatttggggttgataatttggagagggatggaaagatacatagatgcctatatctacatagatagagctctctctatacatacggatacagatataaatagatatctatatgcagatagatatatatctatgaaaatacacatctaaataaccatagatatctattaatatctatgtatctgtatctatctatacattttaacttaaaactttatatacacataagcctatagttctatatttgtagctaagtttaaaaagctattcaagggaagccctgagttgttcttttatggcatctggtggcatttcatatttgacgtgttggttgctattggtgtttgcactggtgaatccttccactggaaatttcatttcttcagggtttaccaatcacctaaaatgttttctttctggataatatcccctgactgctttcttcctcttttagcctaaagtttcctaaaaatttaaaatgcattgtagtcagctttacttacctttcacagaatagcaactcaagaagtgtatgctaagaggaggaataaaattatgtaaaaaatgaactagaaacatagttacctaagacaaaaataataagtggacaaaccaagagtaaacattttacttaagggtttaaaaatgatatcaatttttactagttagggacaatgaataatgcttatcacctccactgttatttagtgttgttctggatgatataacccatgtgtaatgacagaaaaaagaattatggctgttgaaaaggaatagatgaaatttccagaaaataagtttatacctaaaaaagccatcaaaacctattataaataacagaagtacaataagatggttagctataaataaatacataaaaataaatattttttccataattcagcaataacaaatctgaaaatgatctgattcttaatatcaattaaatatataataagtactatagcttaacaagaaatgtgcaggatctatttaaggaaaagagaaaagaagaacttataataatcattttaatacaaaagagtgaattagttgataggtagctaaaagcagaattttaaaaatttactaaaaaaagcaattttgtaagtaaatttgtaagtaagaaagaaaactggaatatatccctatctcactttacatgtcaaaataaattacaaattttatatttaatactttattttttccagaaaattaaatataaaaatacagaaaatgaacagaaaaaatataagtaagttacaaattctgggctaggaagcccaattataaaaagcaaaggaagacgccattattgaaaacatttagattttaaaacaaaaataaaccccctttttacatttaaaaataacatttaaaagtcaattgttaaaaaaaagtaaatgactttaacaagtgacagacaaagaaaccatacccttaatgtggaaaaaacgcttacagatcaataataaggatgcacaaatgacaaaaaagtatccaaatgaagaactacgatgaaagttcaaaatcactattcatcttgtaaatacaaattaaaactagaataagatttcattttaaatctatcgaatactagttggcgtctttcagaaatgccaggccaaactattcctgatgctagaaatgttttgcctgacagtggctgaaaactatttataacatatggaaaggaaattacacaacttgagaaatttcttgcagtgaactcagaaatgaaaaggcggttagatgacaatttcagttcattaatttataaattcacatgctaccacagattttagagatcatgcaattcagtatctccatttaagagtaggaatctatgggctattctgctcaggaaatcagcactatagcatgtatatgtatttcataaagtatctggtggatattactttcttgttttgtttttttttttttttttttatcatttggaggttgtaaagcatgatcagtccttataagggtcacatttagacagctacagattttaatcgttccaaggaaggaatgggggattatttcaaaagacgaaagaaaacattctttgatctaaaagcagaaccaccatttgacccagcaatcccattactgggtatatacccagaagaatataaatcattctaccctaaggacacatgctcgcgggtgttcattgcagcactatttacaatagcaaagacatagaatcaacctaaatgcccatcaatgacagactagataaagaaaatgtggtacatatacagcatgagataccatgcaaacatgaaaaaaaacaagatcatgtcttttgcaggaacatagagctggaggccattaccgttagcaaactaatgcaggaacagaaatctaaatactgcacattctcacttataagtgggagttaaataatgagaactcatgaacacaaaggaacaacagacactggggtctatctgagggtgaagggaggcagaagggagaggagcagaaaagataattattgggtattaggcttaattcttgtataatgaaatcatctgttcattgaacccccgtgacacaaattcatgtatgtaacaaaccttcacatgtaccccacaacctaaaataaaagtttttataaaacacatttctttgttttatacagaccagaatgaaatcatttctcaacacttcttttacattaaagcacattattcttgtttttttcctcaggtattgccctactttttaatcctaatctatagttccattgtaatttttagaatgctaatctaatatttattgaattcttttgtagtaagcaactgaaaaaaatttaattttcaaaaggaagaaaaaatacatgtttaaataataagataacacaactttggtattctaaggaatgtttggggattcattccagggcgctcatattttcaggttagctttcaactgttattttgtcgagtataatcaatggagattttgttattcatgtatttatagagctggttagccataaatagtttatgaatggagacatttctagcaccacctaatggcagtcaagtaaaaagaaaaagtttttctaatttaggaactgttttgcataatttaaattaaactatatagccagagttacttccatatgaaaatgaacttttacattccctaatgcactaactaggcatggaaatccatctctgagcaattggattgagtaggaatgaagctgaagggatatttgataatgaaaccaaggggtttctgctgtctttatgtgtgcaagaataagaaaatacctagctaatagaataaattaattttatgtgaaaattttctttttagtttcagaagcctatgcatactagattttccatactgtagtttcctgaaaaaagtatattttgagtattgtattggcatattttatttgtcttgtttttcagcagttatttatacatctttgaccaatttattctactagtttaataaagcgttttttaaagtttctgatagtttttttaaactgagtcatatcattctgattataatattggaattttctgttgaatatgagtcaaagaacatgctttagatccgtaagctctactcatttatttcatgtgtttcctagcaggatttgaagaatgtgttgtctgtcataaccctaggattgagatcaatggatttggttaatgtatccgaaggagaaggagaacttagcgatagcagcagattctgacacctttcatcctcgtctcaacactttggtttgatactttcttctatgatataaacagggaatactaggcagactgcagatacaggtagttttttgtttgtttatttgtttgtttgtttttgagatggagtctcactcagtcacccaggctagagtgcagtggcacgatctcggctcactgcaacctccaacctccgcctccaggattcaagtgtttaccttgccgcaacctcctgagtagctgggattacaagtgtgccaacgagcccaactaatttttgtatttttggtagagatggggtttcaccatgttggctaggctagtctcaaactcctgacctaaagtgatccgcttgccttgacctcccaaagtgctgggattacaggcgtgagccaccatgcccggccagatacaggtagttataaaaatcaacaagaaagagacagtctggtggtggtagtagtttcaagaaagtgctttctcttcgactgcaatttcttcctttctatgaacatttatttattgatgccctgtaatgcccttcacttctttgtgcacacactgaattttaattcagtcttcacagtcctgcttaaccatcacagcttctgtgaactttttctgtatatcattttgctctcatttcaacaaaattaatcacttttgctattttatagctgtagattacatatccctcttgtactgggtctttataatattttgtactcatttggatacaaatacttctactgctataggatgggtttcccttaaagtaagtattatgcctttcttgtttatctttattattcagagcaaacatgtattttggtgaaagcaaaggcaagttaatggaactgatgtatctttaagttattgtctactgtttattttctctagttttatgttttaatgtaggctgatgttttcatttcttcctttcattaatccatttctttattactgctaaaagttaactagtatttgttgttagttttttgttttcttttgttttagagacagggtctcactatgtcactatcttgcccaggctgtactcaaactccttggttcaagccatcctcctgccttggactcccaaatagctgagactataggcatatgacactgtgcctggctgggtttttgttttgttttgttttgttttgtttttgttatttttaacatcatatgatacttgattgacttttctaaacccgtggattaatatctgcttctaaagtaaaaaattgttaaccttgttattgaaagctagaaagagaaaatgtctggcttaaaggctatcctaaatttttgaaaaattcttatgagaatataatcatctatataaagggtacatttggaaaatacaggtatatctttaagaaagattcagaatttacaagaaaaaatattgaatatgaagatgattagacaattgaacaaatatgtagataaatacatcaatttttacaaaacatgaaatagcattaaaaagagaagaatttatcactgctatcacttatcactgttgcagaggtccgattaatgcagtaagaaataggagtttaaaagttggacataaattgatcagataattattattttctgataatatttcctgtaaaatccaagataatccactgaaaatatagaaccagttgaacaatctacaaattgactggagtcaagagaaatatatataaaacagttgcattcctgttctcacaaaattactcataaaataattagaaacttctgtttcaaattgggatgtagaacagtaagaaagaacttcgctttcatggtaacaacaagaaaaccagactaaagaaatatctttttctatgagtctgtcaaggagcaagcaatgcagaaaaccctggctgaattgaattttaggaagaaataagtgcttcataggtgatcagagtgctgtggcagcttccatatctgaggctaaacacttgttcagacagcggaggagtatgctattgtagatggggagaatttttaaggtcaaggggaaaccatccacccttagacaacaatgtagcctagtaagatgaaattagatctaaaagtctaaatgccaaagcaagtagctcagccccaggttacactattatcctccacacttgaattttgctaagataaagtcagttgaagaggccctagaagtggattcctatgaaattttgccatgattggattccagaattatgaataaatttaatccaaatatgagccaaaaatatttatagtcccagccaagtcccccgctagctcaaatgaggataagatccaaaaggtggcatcaccaatggttgaaggttgagctaaacacaagtgaactaaatacaattaaagcccaacttcagttctacataagtcagtagaaatgtatccacagattgccaaattactgtaattagaaagcaaagaatttaaagcaaatattgtaaacatttaaaaaaaattaaaggtaaaattcatataatggatgaaaagataaaatattttaagagataaatgatagctctaagaagaaataaaatggaaattctagatctgaaaagtataaatttacaataaaaactttattggataagtataatagcaaattggtcagtgcagaataaaagattaatgaatttaaacacatatcattatgaagtaaccaaagaaaaatgaagagaaaaataggttaaaaaataaacagatcgataacatgtggaataatatcaggagatttaacatacatggagatgtgggttccaggaagaagaaataggcagaaaaatatttgaagaaataactgttgctaaatattcaaatttgatgatgaaacaacctaaaaatgcaagaagctcaatgaattccaagtagaataagtataatatagccacatattgtatactcacagtccgattactaaaaaaaaaagattatggaaataaaaaccttaaaatcagctagagaaaaggaaaaaggcactacatagaagaaaacaatgaaatgaatgaaggctaacatttcatcaaaaataattgaggctagaagataatacaatatctttagaaactttaaaacaccaatctcaattctatattcagtgaacgtattattcaaaaataatttgaaagacatttttagattaaagaaagagttagtatatcatgaatagtcttgcattacaagaagtgctaaaaaaagttttaggctaaaaataccaataataactcaagtgtgaggaaaaaatgaaggaaaatggaaattaaaaatgtgaataaacagaaaatattattaaaaactcttttgaagacatttgattagtgaaaacaagaaattttaaacatattctgcagtttacaacatatataaaattaaactgtataaaaaatagtacaaataattggacaatggtaaatggaagtatgttgctgtaaggatcttatatgtgaagtagtataatgttaatttgtgatagtatgtgtgttaagaatgcatatgatgatccttagagagccattttaaaaagtctaaagtctacctagggagatgaaaaaggtagcaaaatggaatgttaaggtaactcctctaatccataacaaggtagggaaggcacagcaaagaagcaaacagcaaatgcaaaaaaaaaaaagaagaagaaagtaagaaaagagagaattcaaatagcaagatggtaaaattaagttaaaaacatattaataattatgttgaatataaatgcacataacacaacaatcaaaaagaatagattattaaactggctaaataagcaagacttacaaagggtgtacaagaaacacacttcaagtataaaaacataaaaagcttaaaagtaaaaggatggaaaaaataaaccatgaaacatttatcataagaaaatggtagtggcaatatttatatcagccaaaattacctttaagaccagtaatattactaaacagacattttataatgatagtcaattgattaagaagaaattatcctaaatgtgcttatatgtagtaatagagtttcaaaatacataaagcagaagtttacaaaccaaaggacaaaatagacaaattcccttctatatttcaagatttttaaatgactttcttagtacttaataaaagaagttgataaaaatctataaaaatacagaaaaatcaaacacactatcaacaaacttcagtgacagttattgtacattctatacaaaactggaaaatagctattgtttttcaaatgtacatggaaagtatgtatatttgaaagtatgtacactacaaacattctacagctaatatgctgggccataaaagaatcttaatatatttaaaaagttgaagtcagaatatattctctgtttatatagaattaaattagaaatcagtctgaaaatgctatctggaaattttctaaatacttcaaattaaacaacacatttctaaatgccctaccaattaaggggaattttttaacaaaaaataaagtataacatgaactttttggaatgcaccccaagtaaggcctggagagaaatgtataggttaaatggttatcttagaagaaaaaagtccaagctttcctaagcttcttcttaaaacaggcaaaaaagaacaaattaagaccaaagtaataagaaatgaaaaaaattaaggcagaattggatatcaatgaaatggaaacagaaagcaaagcccagaattgatttgcaagaattatgggtgttggggaatggagagtggtaaggggagagaaggaggggggagagagaaaaggagaggaagagagagaaaaaaatattttggattaattttaaaaatctatcgatatgatttaccacattaatagaggaaatagtatagcaaaatatcatattatctcaatacagctgaaagacatttcacaaaattttatacctattcataatgaaaactttcagcaaactaagaataggagagatgaaggaccactacaaatattctacagaatacatatacatatatatatatatagtatacatatatgaaatgtacactacaaatattctacagctaatatgctgggccgtaaaacaggcaaaatatatatacaatatatatttaatatatatttattatatatacttatacatacttaatatacttatatatttatatatataaatatataaaagtgaaatagtgcatgttttgattttaagatagggatcaagttttcgttcaaactttaccagtagttctagccactgctaaaacaatacgataatataaaagtcataaatatagaaaaggaaaagaaaatgtatttgtcatcgacataattttgtatgtaaatgctttaaaaaatctttgaaaaagtgttaaaactaataaatgaacttggaaagattgcagaatacaatgttaatataaacaaaattaattgaacatactagcaataaacaatttaaacaaagttggatttaaaagaatattcaaaacatagcacttaaatttaacaaaataaatgaaaatatttgtatagccaaagctataaaacataacttagaaaaatcaatgtaaacctaaatagatgaagatttatcatgtttgtggatgaaaaacaaaatattgttaaaatagccattttcctgaagtcaatttattcatttaatgtaattccaatcaaaattccagcaagcttttttgaagaaattcccaagttgattctacaagttgaaagacctagaatatccaaaatactattgaataaagtattaaaaaaatggcaaactgagccatcttatttcaagatttaaaataaagccataataattaagacttcatagtatttgtactggcaaattaatcagaaatagactcagacttccaatgtcaattaaaatttgatagaggtaaggcagttcaatggggcgagtacaatcttttcaacaaatagtactgtatagtgtataggagtcaaaaaaaaacaataaagcttgacccctatctcacatcatgcatacaatttaatttgagatgggttcatagacctaataaataaaagctgaaattataaagcttctagaagataaatgagaaaatatcttgatcatcttggtgttggtaaagatttctcagacaaggtacaaacaaagcgctaaccattaaaaaatggtaaattcaacttcatctaaaatattaagaaaatgattgccattctaactgatgtgagatggtatctcattatggttttgatttgcatttctctgatggccagtgatgaagagcattttttcatgtgtctgttggctgcataaatgtcttcttttgagaagtatgtgttcatatccttcgcccactttttgatggggttgtttgtttctttcttgtaaatttgtttgattctggatattagccctttgtcagatgagtagattgcaaaaaatttctcccattctgtaggttgcctgttcactctgatggtagtttcttttgctgtgcagaagctctttagtttaattagatcccatttgtcaattttggcttttgttgccattgctttttgtgttttagacatgaagtccttgcccatgcctatgtcctgaatggtattgcctaggttttcttctagggtttttatgcttttaggtctaacatttaagtctttaatccatcttgaattaatttttgtataaggtgtaaggaagggatccagtttcagctttctacatatggctagccagttttcccagcaccatttatttaatagtgaatcctttccccatttcttattttcgtcaggtttgtcaaagatcagatggttgtacatatgtggcattatttctgaaggctctgttctgttccattggtctatgtccaacaatgacagactggattaagaaaatgtggtgcatatacaccatgaaatactatgcagccataaaaaatgatgagttcatgtcctttgtagggacatggatgaagctggaaaccatcattctcagcaaactatcgcaaggacaaaaaaccaaacaccgcatgttctcactcataggtgggaattgaacaatgagaacacatggacacaggaaggggaacatcacacaccagggcctgttgtggggtggggggaggagggagggaaagcatttggagatatacctaatgtaaatgatgagttaatgggtgcagcacaccaacatgacacatatatgcatatgtaacaaacctgcacgttgtgcacatgtaccctaaaacttaaagtataaaaaaaaagaatcaaaactttaaattaaaaaaaaaatgaaaaggtaagtcaaagactggattcggctaggtatatgtttaacttagagaatgccaagcagttttccaaaatgattgtttaattttgcctttacattagcatgtatgagagtttccattgcatcacctattcagcagattttggtgtttttaatttgaccaattctagtgagtatggagatgtgtctcattgtagttttaatttgcagttcctggatgaatgatgacactgaacatctttctcatgagcaaatatggttatttgcatatcagaatttttagtcaagtgattgtttagacgttttgctcattttctattgggttgcttggctttttattgagttgtaggatttttttatgtattctacatgtccattgtaagaatttaaatttctgataaaagattaaaaaaatctatagtaactttttagcagctttttcattcatactagggacttgtattacaggttccttctcttgatttggattttggaaggcaaaattttcatcagctgaaatgtattagttcttgatttctttttgttcttacaatagctttgtatggctattacttgacaatttccaatcattttgaaatgtcttacattttcctgtatctgcaataacaaagttaagttgacagggataaaggcttttggatggctttttatgtttcttagttcaagagagacacatttggtttttgaaaaatgtttgtgttgaagtctaacatacatacagaaaagtgcaaaaagtagcagtgtgcaggttgacccatttttataacccggatagccttgtgtacccagcacccacagtacaaaatagaacactactgggcccccagtgggcctgccttgtgccctttctaaatcccagccaggattacctctatccagacttctaacatcatacgtggatttttgtctagttttgaacttgatataaatgggatcatacagtatatattcctgtgtacttagtatctcttacacaatccatgtttgtgagattcatgtatatagttgttcattctcattgctatatctgttgtttgtacagttgagtgacacgtgtgtatgtttcagtttgaaggtgtaatgaaaggtcttgctgtaaacatacttgtatatcttgtgaccctatgcatttgggtggggctggatgtagatccaggagtagaacggctggatgaaaacatacatatatcaaaagatacaagggtaacttttttgtttgtttttgagacggaatctcgttctgtcgcccaggctggagtgcagtggcgcgatctccactcactgcaagctccgcctttcgggttcacaccattctcctggctcagcctcccgagtagctgggactacaggcgcccgccacgacgcccggctaatttttttgtacttttagtagagacgaggtttcgccgtgttatccaggatggtctcggtctcctgacctcgtgatccgcctgcctcggcctcccaaagtgctgggattacaggcgtgagccactgtgcccggcccacaagtataacttaataaatactgtcagtttttaaaagaggttgtacgctccaactagtagtttatgaatgttgcatgtatagatattattacattatatattataaatttaacattttactttttaatttaatattatatataaaaatatatgtaatatatacgtgtgtgtatgtgtacatacacacatatacagtagttgcacatatttggctacactttgtgtttccttttcattttagccattctaatggatatttagtggtattgcatttcattttgcatttctcagatgactaatgataccgaccatctttttcatattttttttttctggctatgtatcttggtatcagatatatgtattgcaaatatctgctttcactatgtcatttgtcttttcattctcttattcataccttttgatagccaaaagttgttaattctaacatggtctaatttatcaacttttccctttatgttatagcttcacatttatcgtttaagaattctttgcctaatccatggccccgaacgtgtatgatttttatgattaaattttaaagttgtaaacctcttacttgaaagttaaatatttccatgtagaacttggatttttcatatttttagaatgttaggccatggatgtaagtttattttacacatctcatgtataccatttgtacaaagtatgtgttccttaaatatttcctgaatgaatgaatatagagatgcatgaaatgctctattgtttaaacactagaaaccaaaacactgaactttagaacatttcctgtctcattttttgaaaatcaaagtctaaatttcagaaagtgagaaaagtataattttcacttgtctgcccattttagtcagtgtttcagcttaacacaaacattaaaagcaaaaatattttggcactgctgggctctgatccacagctcttcttattcctgggcccaggatgataacacattcatgaggcagaggggaagacaagttcaactacacagctgtattaaaatttctgctctcctgcgcacaccgcatgtccactttcatttctttggccaacacaagtcacatcactaagcctaagtcaatagttgggaatctgtaaatacataatcttcttataggaaaagagagtgttaataattttgaatagttatgcatgttaccattctgtctcacggtagagtcagtaatgttttctttaaaatgttttatatgttaatcaaaatattatgtttatatttaaatgtattcttttttatttagttcatttaaagaattgattacatgatttcagcatttggctcaaaagatagaatttatctatatctatggcaataattaattgtcaagaatatgtttcagtgaacgtgtgcatttttaattttgtcatagattttgcacaaaagacattcattatttattttggcagtgtaaagagaaaaatgagaagattaaattatttggaaaatgctgtgggaaagtctcacatacaccatcaattccaattgcctttttttatactatagcttcccttcttaagaaattttccttgatctgtgtaaaatattatattttagttgcactagcagtgcattttctcatataagcataaaacttgaaaattaaataatatattttagaaaaacacacgaacttgcatatttcttaaatagtgcataatttttatgagattcccacgtatatcttgtctaaatattcctgtaattcttactgatttattttcattcatcagatttctcttgaattaaagacaagtagttgtcttcccagattgagcaattattgatatcttccaacacccaattccttgtttttattctcctctctactgccacatagatgactccaacacactggtagagagttttgctctcttcatgttccaaattatagcatttttgtgaaataacctcaagctgagtaattttataggaataggttttattataatatatgataccaaatatcacataaaaagtggtgacagaaagataagatttctcaagtagtgttactctgaaccataaggagagaagcttaagagaagaaaagagttggtagaaatataattgttctctgctcaggttgtagaccagactctacgtctatgtttctgctggtagatgcttccttttatctccctggtctaccctgataattaatttatatgtctcccatttctttctctatcagatttttctaattcgtgttctgtacccaccttctactcattcatttcctcagtccttatcacccagcagtcaagagtctgtccattctacttaactgaaaaagattatgtcattaccagctccgtaagtttttcttcagttctaattattctggacctattggaagtgtttacacagttaactaaccttgcctccttaaagttccctcctatctagatttccattttacaatattatcttgatctaactttattcttgcccttgtttttttcttttctgaaatgtggacatttccattaaaggctcttgttctttttctacaatctgtctcttagacatggcttttgataggtgattgccaatgtattttcctagcatcgtcttctcttctaagatttagtttctcatttccaaatggcaggcagagttttctgcatcataagttcagtatgcctaaaactaaagataattcctaaccccagatttccttccttatctgacatttctatttctgttattaatgccccattttcctcaataattggtgaaaagaatggaccattttgccccacaccatcacctcatatcaatatgtcttaatgtgcctttcctggtatgtatagagtttatcctttcaattactaattcagttacttgtctgtccttgtcttattctcccaaagcacagcactcacctcttttctgtgtagctaagttacgtctcctccctacatttcatcatgaattttgttgccttagtctcaattttgaaaatcctattcctgctctccactcaaattttaatttcttccattaatttatgggatatgtttcaaatgggtggctcaatcatttcagtgcacttaataggggagatgagagagaacaatacatctagtagcaggagtccaagtgtgtttgactactgaaaagcaatttgttggggcaaacaattctattctgtggagtggaagagttgccaggaaggactgcatcctgaatctgacagcaagaacacaacattcaagcaggccagagtaagagaagaagagagtgtgtaacaatgagaaataaaaatcactaggacaagtttgttgaaaatgaccaagagcataaaacgtagaagatggagatgcagaagtcaagaaggccaggataaatttgatttgccttcttggaaagtctaaagcttgtatcctaaacttaacctttgctgtgactaaaggaatagcactctaaaaatgacttagaacacagcattctttttcatctttgtcttctatacaaacttctcaagccagattgtacagatgtggtctcacctatttctccagatttatctaactgtctccctcacaaccagccttcctcaaactttccatacctctaggactttgtacaattcccgccaaatccttcatattctctaaaaacaagctgaagtactatattatctaaaactgtcctcaatttcttttaatcaggtattttgtatacatccctataccatttatcacattgcattacatttttttaattgtcttttttctcaactagaactcaatgtcagttatgggcttattagtttttcttctttgctgtgtatcggagtactattcaacaaatgttagtgttccatagatgtatgttgaaaaaacgacagtccaatgttcaccaaatgatatctgctttcctgccttcaaatcctagctaaagtttttctcttcagacatggcttctggagtagttgctgtctattgaaactgagttaaccaccacccacctatgtagggcttttggttaccagcccagcctgaaggaagatctccttcctttaaatttttattatcctgcctgactgtatttttactcaaatcagtattcattcattattcactattgtgttcttgagatgttatttgattttcatatatggtcttgagctcttatttgattccacaggataatttgttaagacatatacatttaatattttcaactaaactggaaattccttgaaaacagagattgtgtctcttaccagttttaatgcattaagcaaaaagccttatacagggcaagagctccacagtatgtgttgagtacgtgggatactgagtagagtggagatggggccatgtaatggtaggactggagatggggccatgtaatggtagggggaaggcatcattcataggactggagatggggccatgtaacggtagggggaaggcatcattcataggactggagatggggccatgtaatggtagggcgaaggcatcattcatagggctggagatggggacatgtaaaggtaggggggaggcatcattcataggactggagatggggccatgtaatggtaggggggtgacatcattcatagggctggagatggggacatgtaatggtagggagaaggcatcattcatagggctgttgcatattgcccctgcttcctaagctgtggaaatttctatgagaaaagagcattgtatatcctatgatatgcagggctagtatgtgctctgaagggtcagtaaagatcccaaaattctgaaggctgcaaaccatttggttatagggtggtgtttcaggaaattacctctataggcctcttcatggcaggtctttccaatattaacttctattactgaaccgattctttaaacttcataaatattttaagcaagaccctctgtgtttctttcactcttgtcaaaaacccatttatttttatgactctctgataatgttttcacattgatactctgagtatccaattttgggttgacaatatgtctttttgggttgatgagttttgcataaatttaaacttcattatatattgattagcaggaatgtgggcataagattccaagtactgaatggcatttaaaatgggatatatttaaaaccaaatggcctagaccatgcgagtatattgctgtgtataatttcctgactgtactcactacatcataaataataatgaaagtaaatgtacatttatcagaaagaatcaacaaaaccccagcactgatttgctgatcacacttgtcttaccaggcattaaggccagctttcgaacaaaagtgcctgaaggtttgattgtctttgcagcatcacctggcaatcaggaagagtattttgcacttcagttgaagaagggacgtctttattttctttttgatcctcaggtaaatgagaaatcataaactttaatatttttaagaatttagtaggtgcctggtactgaggtaaatgcttctgttttcacactgaatcttcattcaaaccttgtaaggtaagtactattattatccccattttgccaatcaagaaaatgaaacttacaaaagtaatgtgacttgccctcagctaaaatagcggagctaacttttaaaccatcatggtctgactgagaatctgtgggcttaacaaccaaaatgccaccttataatgaagattaaaacttttaaataaatttaaagagatctatttttatttttcttagtagcaaaaaatcatgtccccttttcttccttccctgtctttcttttttcattgtttcaccagcaaatatttaagtggctatcgggtactatggtactgggcgttgcagactaccatagtttcaaagttaaatatgaccatgcccctgcaaaggatacagtaaaataatcaatttaaaattcttataaattgtatcaaaataaagatttaggattctatgtattataggaacataaaataaagaaataaattgttttctgagttgtcaattttctctggaaatgtgatatttaactgagatacaaatcaatgaagaaaagttggtcaggacaagattatatgtctgtatttgagggtgtatatttcaggtggggcagtacaggggagattctgatctccacctgggaaggtgctgagcataaagtttccaggcaaagtgagcagcaaatattaaggaaatagcaaatattaagtgcctgaggtggacgagaacatggcacattcagtacactgagatgaatctcttatggctgggaacagagacaaagggaaaggtggtagattgaaaagctgggtagaaaccaagtcatttaagaccttgtaagcaaatgtgaggatatgaatttttcctaagggcagtgagaaagcactgaacagttgtcttcacttgagttgaacaaatatcagtgagcatttgatattaggtattgtattaagcatgtgagatgagtaagagaaatgagtaagactaagtaaaatatattagctttccattttctcagttcttcaacttaaaactgatgatctaaatcacacgttatgcttgacaaataaatgttttacattttattggtaaagcagacacaacgttcaccctctgtatccaagttgcgtctaggatcatggactgagtgatctgactgaggatctcagcctcatgaaccctggagatccattgaccttagagagaaaaggcagggcctattgtaccaagtgtatctgaggaccctgccagactcaaaaagcaggccaaagtcctcctgctttatgaagctgggagagccgcacagtggccactcgaaggaccagggacagaaaggctccctcctcatgacttgacagggctctgctaactccctggctggtgcacagcaggtcctcagacacaaagatttctgagcgtcccctagtaatgcagcttcttaaaggatgccagcaggtgggcagtgagtaagcaaaaggaaatagcatcacacctaagcagatcctgcagccagagggaaaggaagaagcagcagctatcgcagaaggcaagacagatggcaactgaaaaaaatttttaaaaaatcagctgaagttgattcaattacataatggaagatattattttttatttgaaaactttaagtagattaattagaggagagacactgagcctcagattagtaggtcagaagattaagttgaagaaatctctcaaaatacataaaaatgtgacaaaaacaagaaagttagatactactactgtcactaagaagcgaatcggaaggagaacaaaaagcacatgctcaagaaaaagagggataacataaaatgatgaaacaaaaaataggagagaatatctgatttaagagggaatttagtataaatccattgaaaagactcatcaatttcctgtcaagattaagcaaaactaatacttctatgagacctctttgtgccaggcattattctaagtggtctctctatacatcagtttgtacacttacatacacacatatgcctatacacacacacacacacacacacacctacacacgcacataaactcatttgaacttttcaacaactctgtgaggtagatactcttcatattcccattttacaggtgaggaatctgggccacaggtaagttaattttccccaagtcacaacactaataagtgaccaagccaggttataaacacaagcaattgagctccaaagaccatgattttagctacagtgctatactgcttttcaacatgaaagaaagatggttgttgatatccataaattcagaaaaaaaaaatccatctctgcaccaggttggaaagaaatatttcagtaagtaatctagccaaaaggaaaaataacagagtcagaaatataaaaagaagaagcatcagtgaataataaatctagtaatattaagttatgcctaaatatttaatgatagagtgactagaactctgttttacagtgccaaatgagaatctttgaaatagaagagaagtatagcaaaggcaagaaaaaaaacgtgaataatcatttgttgctaaaattagtaagatttgaaggagaggaaagatgagtgaattaaaagttctgaagataccagcttagtggcggggtgtgggtggaataagggaatagattatactgacgttttgttttcgttaaataaatagggcaaatgtttgatttcaaatgttatagaaaaataagttactactaataaaaagtgctcttcaggacatccaaattaacaaggttaaaaaggacagcaaatgctaagttaaaaaatcaacaaaaatcagaaaaagaaaggggagagtacagtaaaatagaagactgtcaatgagaaagaaaaatctggctctgctttttccccttcaacctgttagtatctggagatatttaagaagaagccagatggaaaaaaaactaatcacaggaccacttgtttatagagctttaaagtatacaaagtgagttcctgttaatgatctcatttcattcttgaagtagccccttgaggttgattttgttttcatccctgctttagatgaagtggcttaactacggtcatagagtggtttagggatagaactagcactgaattcaattatttgaatagcactgaattattttattcaatgaaactttgctaagaatttattggacttcacagttatgcactgggaacacagaaatgaacagaatgacactcattggaattctggccattggttgttcatcacagattttgagtatttatagccacccccctaccaaacatgggacagtcattggagaattaatccaaaaatgatttccccaagtctgaagcatgactgccatctcttttgacatgtggtgttgctatttctaaaggatgcgataccttaagactctgtaggataggagggtaaaggggtcaaactgcttaacggagaatggctgccaggaaactcatctggcaggtctagttgttttcatatcctttacggtgatcacctggacaggctggtgcaaagcgtggtaacagaattcagggaaacattcacagggcatttgcccatcatttccgcccccttacccttctcattcacacaattgcttagagtactcgtcactgctattagttttcccagttgctctgtccctaccctgtatagccaaaccctaagctgtatacatagtccgcaggtgccagccaagtattaataaaattgttaaagccactgggcgtggtggctcatgcctgtaatcctagcactttgggaggctgaggcgggtggatcacaaggtcaggagttcaagaccagcctggctaagatggtgaaaccccgtttctactaaaaatacaaaacttagctgggcgtggtggcaggtgcctgtaatccccgctactcgggagactgaggcagagaattgcttgaacccgggaggcagaggttacagtgagccgagactgagccactgcactccaacctgggtgacagagtgagaccttgtctcaaaaaaaaaaaaattgttaaagccaagttgggggctaaagggagtgaggaaggtttaatgatgtctagtaagtaaatttttatctgaaataatctctctccataaggtaaaactgcttgagttttcaggaaagtgacaattattttttaaaatacaagatatgggttgagcaggatggccttaggatctagctgagaaaatgtaatcagatgcattacactatgtgctcacgggccatgaggctctctatatatgaaacaacgagcttatgctagcaaggactgtgtccttccttacttccaatgaatttatactctaaaacaggtactaaacatattttctaaatttataatgaaagccccactcatttttagacaaagaagtgttaaaactgagggatggtgaaaattttgaatactcttctcttatttgctctctttttccaaagtaatatcaatgcagcttcttgtatgaagttagagctactctgggttttaaaaagtatagaagtttatttcatatgccttctattggcattacatttatttatattttaaatactttgggtaccactttaagtcagtttttctcctttaatctttaaatgcggacgagattatctagtgaatactttttatactcatcacacaagtaattatgtacttagtgtgtctgtcttatcagactgtatgatccagtgagggcaaagtctatgaatcttttgcccacaggtacttcctcaggacttagaacagtctttggaacatagtagatgcccagtaaataaatgaccattgacatattacctggctgattgactcaataactgttggtaggatactactactcataactgaagaaaattatccatttttctggcttacaacgtctagctttgtaatgattacacagatattttgtgatgtttgttttatttttttttattttgaaaaaattagagaaaaagtcttgctgttttgctcaggttggtcccgaactcctggcctcaagcaatcctcccaccttggcctctcaaagtgctaggattacagacatgagacaccatgcccagccttgttcaaatttgtctgtttttcagataatttgatttttatcaggaaaaaacgagatgcttatttttaaattgtttttactgaattcattcaaaatagccaaattttgaattatgaagagaatttcaaggaattttaaagtagttatctagcacatatttataaaataacttgaagtcattgtgtactttgctctttttaaaatatcttaataaaattgagtattaaattccttacaaaacaatttaatacaacgtagaggctatagatataaaaatgtatttggtttgtcatccaactatccgaagcattctattgaataaatgtttagggaaagggagattcttcatagtacataaaattggaaatgtgtttgtatattacaaactgggcacttgccattgttaaaagatacaataaagaaaagttaactgcaacttttaattacagtttttattgttatctccaacaattttctataattttcccattcttcacttaattaaattcaattttgaatatacttgatcagataatattttagtgaccagtaatgatctatgtttatcccttaaatattctatgttcagtgacattaacaggaaattcacatcatattctgggcttacttggaaggaagctgtgaaaatgaaagctttaaaacaattctgaatagcatctattgaatgtgtctgatatgttccaaatagaaagaacaacatgcataatatgacaccagaagtcatcacagaattgttctttcaacattgatggggggaagtaatcttaaaatagtcttcaaaaaatgatattctaaattgctgtaagtataaagtgagtttgtcatgctgaggctgtaggtaatgtacttgaatttgtctccaataaacttgatttctgatgtagagaactattaatgcttcagattgttgccaaacaaaatatgaagaaccacttattcagacacctgatctttagaatgcagcatcgtttgtaacaattttaacgctaactaagtacactttgatgagacagcatttaataaaatgctcattaatttcatcattagcaagggtatgctaagaagtaagccagtttcttatgtcacgcccaattagcatcccatgctagtaatcccattagtattgttgaattcactaatggaaaaactaatgggcatgctaccagggcacattaattgggcacgacaccagttctggttttaattattaaactacgataatgaaatgtgtgtttgtaaaatattaaaatgttgaaatagggttgaagaaaataaaagggtgtgtagacaaaacagatataaggaaagtcaacctacaaaaatacgaagactagaacttgccagatggtcatgtttctagctgatggagttgtctgtaaaagttgggatattgtccatgtgagagacaacccactcatactcatgggaaattaaaagctttttttttttttttttttactttggtaacatgaaattctgtatgtcatacatgttgtcgagctctttatgaggcccgacaggaaccaattaaatgtgtagagtggacatgttgtatcactgaagccatttcagagaaagataaacagaaatcatactaaagatggtatgattaacattgtatgtttttcaatatacatcttcagcaccattacatcaaacaattatctattttctctttttgaaaaaaacagcatagcaaaattattagagtttggtgaaattttctggtaattaagtgttttggtaatattttacccaatctaatttttttaatttttaaagattttattagaatgagctttattcttgttaagtaaatcaactttattaagaagaaaattcattcccatttagaagttgtaatttcttttttatttttatttaatagtagtactagtagctgttggtgacaaagttgggatatctttcacttagtcttattcacttaacacagaaaatgttactataggtaaccaaggctactataacatactggaaaattgtttacttttctcgaaagtagtgagatggcaggtgtttcttctatttctctttctcagtttttttttttattcttacctcctatttgctaaactctgttcttaatatctgccatttcctatgtcttatcacttaggaacatgtttttaactattatatgattaccttagccagaactataattattggattttaactacaaagcattgtgtactacatttaactccacccttatgtttaatgtatcacaactggctagtttttaaggtgaatgtcattcccatttgttattgataattttgtgaagataagagtgacttgtctgacatctctctatcttcagaactcattttgagtggtattttatgagttttaaatttttctcttctttttcatatttatgccatgaaacttaaagtctaaaattttagaatagaaaattctttacccttctgatgaatagctatattcatcagaaaatgcaagtgactttgtaagaaattcttactgcaaaggtgagacctttacagatctgtacactgtggtgcacagggaagtattaatacatcacaggaaagccagaatgatgctagacatcagctttaattttgagttctgtttgaaatgtatgcatgcttgtatcaggatcataatcttgaaacttgtaaattggtttataacaaatatgtgtgtgtttatttgtagatatgcatgtataaacatttatttattcattcattcccttaaggggtcaccagtggaagtaactacaactaatgatcatggcaaacaatatagtgatggaaaatggcatgaaataattgctattaggcatcaggcttttggccaaatcactctggatgggatatatacaggtaagtactttttgatatgtataaatagccctgttgatatgttggtgttgccatacttttctgttgtttatattcctacattcttatttcaccataatttctactcaattccatatatattgctgttgaatttgcctttgggatgctcctaaaaggatgaagtctggcaaccagtttttcatccatgaaggtctttggtaaagaaaaaaataacaatgaagtcacctatgtcttttacagttctttacaattcgtgtggacctttagttatgttctgtcatcttacttttgacttccaaaaaacacatacagtagaggaaagcagtttttgtctgcatttggagatgaggaaaccaaggctgagaaaaaagtaaatattttttcctaacttacacagttgagaggaagcattcttgggacacacatcctgttttttcacatttaagtttagtttttgctccagcctaccctatctgccacatttatgtaattataacatgatcactgtacctgtataatgatgcaggcttttattaaattattcaggaaatatctaattttaatcagtacctattatgttccaggtattgttctaggtgctctggatacaaggagcaaagagaatactgtaaaacttacattttatgggaggaatggggcagcaaaatacagaataaataaatttaaacaaatatcaagtggtgataaattctgagaatgaaaaagccagatgagagggaaagttgtgtgtgtatgtgcgtgtgtgtgttaagaaaggtctctctgatgaggtgacatttgagcagagacctaaagggacaaaggggaaaccatgtaaatatccaggaagaggatgctttgggttgcgaggacagcaagtatcagggccctgaagtgagagcacactacatgtggcatgtcaaggaccaacaagaaggccagtgtgggaaagagggtgtaaaagagctaatgacatgacataaggtcacagaggccattagggatcagattatatgggaccttgtgggcttttactttgaaagaaggaaactgttgaaggattttgagggaagaatgacataatatgacggctttctttaaaaggatcacactagctgctctgttgagaataaattttaaggggaatgagggtgaaggcatggagatcagttaataggcttctgcaataactctgtaataattcagacaagaaatcatggagacctgaaccagggtgataattgaagatataataagaagtattcagattctggttatactgtgaatgtcaaattaacaggatttggtgatgagattgaggcagaataggggttggtaaactatcaccatgggctaaatctagctcatgcctgtttttataaagttttattggagcacaactacacccattcatttacgtattatctatggctgcttgagtctgaatagtctacaaagacactgtctggcctttgacagagtttactggcccttaatgtcgagcaagcctgtcaggtttgggtctcaggcaactggaagaatgtagctgccaaaaccagggagtgcatgactgtgggagaagcaggtttggggagagacattcaaagttcagttgagaacatgttaaggctgagatttctaagacacccaaggggagatatcaggcaggctgctcaagaaacaagtctagttctgaagtcagaacttccagcaaaggatggtattgaaagccaagggaacagatgtaagtagggctaattggagtggattgggctctggaaaaacaaacacaaataactttgcctcttctctcaaagaaggtgggcattagaaatatgaacagggatttccattgttatgccacacagtcagagacccaggttcccctggcctttggccctggcagttcgtactggaacccagcccactattcatccctctagagtacttagggggtgcctatgggtagagaaaggaagaggcctgagaggcaggcggtctggatcattccaacatcatgatgctgggatgttgaggaagagccagtgaagaaaagtaatgaacaggcaatgaggagagaggaaaaccaagagagtggtatcccaaaggctggtgaaggattttattatttgctgagctagtaaaactagagtatcctggtgaaggtgtatttctcatctcctcttctctaggttcctctgccatcctgaatggtagtactgttattggagataacacaggagtctttctgggagggctcccgcgaagttataccatcctcaggaaggatcctggtgagtttagtaaggtatattatatgttgtcatccaaacttagaatagaacctgtttacattattttaaagtaagaataagtattatgttctacctcatgctatattttctatattaatgtgccaaaaatttcctttaggtctcttttttttaaaggaaccatgtattccatatgacttgtatttatattgttagtactcggttcttgatatataaaaggaattcattaaaacttttgctgaaatgaattataataatttcagtcaaaggtatgttattttaggacctatgcatagttttttctaagattttaaattgaatgtgaaacaacacagaaatggaaaactatgagcttgatttatactctaaatagggtgaagaacattccctgaatactatgtgataggcactaaaccaatccctagatattcatagatgaataaaatgtggtctttatcacaatagaggtcacaggcgtataaacagacaattccagcctaatgccattagtgctataattgagctatagacaaagtgattctcatatttttagaacaagagcataagaacatattctaaaatgaaactaattaaaatgaacatgaatggaattaaccttagataggaaaaaaaatcacccttcaaacgcaatgctaatattctaggattgtttcccaagtcctcattaagaatcacagggtgcctcccaagtctctcccaggaagttaaaatataactacataaatattacaaataagctagaacccagataagtataatttgttcatgggttgcagtctcagggaatcatgatgaagatcaaaaggaatagaaagtgttcatcaaatttaggagaaggatatagttgaatcctcaaggctgattatagttacctcctcagaaatgtctctagattagagagggttttcattcaactacttgagactgacagagaagtccctctaaaacacacacacacacacacacacacacacacactcacgtacacagcctttgttttttgcccttctgggaaatagtatcttcaggtactaggagagaataccctgatactaagtacccttcctgtagaggacacatctccattatgaataaccaattttactttgtctatgtaaattggccttataaaactctcataaactcaaagctgaaaactaagctttgcccccataggaaaggaggtggctgtgtgaaattcgacctcagtgcaccttctcctcctcttgatttttttttcttgctttttctctaattctctcatttgcacattttctctctcaaccttctgttatcaccctattcactgtatttataaagccacctctacctggtctggagagttccacattcaagatcaacactatatacatttcccaaaatatgaagccaaattattgatttacttcagtaacagactggttcatagatgaggaatctaaactgtaaactatatattaaatagaaacactcccttccaatctaacttttaaaattatagtactttatttttgaggctagtggcagatgaattttctgtgttagttgaaaaggcaatattcttgctactgcaaaaccaaggtttctgcataaacatctgtttctgcagatatgatgggtttgaaccagcactaaacattataattgctatcatttactatagctgatggtgtggtgtttacatgaatcattaagaggcttgcagtaaataggtagtgagagctagtgcctatttctttgactttaatggcacataaaattaattgcttgaaaataatctttcaaaatatatatttcttgatatctataaactcctgcagagataatccaaaaaggttttgtgggctgtctcaaggatgtacattttatgaagaattacaatccgtcagctatttgggaacctctggattggcagagttctgaagaacaaatcaacgtgtataacagctgggagggatgtcccgcttcattaaatgagggagctcagttcctaggagcaggtaatgctctaaaaaagacatgagtgttcacttaaaatctatgttctatcctttgtataatttaatctctcctgtttgattaacttgacctcatatgaacctagtatcacagaaatacttagttattccaatggtgcacacaaatatattcttgacatctgaatatgcaatataaattataagactcataagtatacatccatgtatgatatctctggtaactcatgcagttcttgatttacatatgttagcatcaccaatgtccatttgcaaatcagttgtttggaaactagaatgcagttagagaggtgtacttagaatgcactcagaaagatgtttcaaagagttttgtttactaggttaatccacaaatgcctatttatctcattatatagaagaacaatgttcttagttaattctcggctaggtaatgggttaagtaggccattgagagagaactggagactagaaccaccatccctgccattgctcaaaaggctacaatgaaaggggaggtgtaagtgtctgtagcttacccctgacatgcatgcacattgagtctctgcctgatcagagcagagacttccacccaggggaaggggagagggatgatggtggcttggtgcacccggcttgttcatcaaataaaagcccatcactgcctcctatatttacagctaagttggttggttattaagttgcttaaactgccttcagcacaaaaaggcatatgatattaataatataatctacacattttttattctgttttcatcaaggtcattctgagtttcttttagtcaatgcaaactacttattgttaatatttatctgaaacagtaataatcttacatgatacagacaacacatgatttagagagcaaatttcttcctgttaaaaagtataatatatatcaaagtctttcttagtatatcaaggtctttctgtcacttctgtgcaattacaaaaggaatttcttaacattgatttgcatcttcttttgtgagatttactcagtggcagactgtgtcctagagtttcttagcacccttacaatgctggcaatattgtgttacacatgctaatatgtacatatttttatctttaaagggttcctggaacttcatccatatatgtttcatggtggaatgaactttgagatttcctttaagttcagaactgaccaattaaatggattgcttcttttcgtttataacaaagatggacctgattttcttgctgtatgtgaattaatttgattaaaattactttaaaatataggacccaactttaaaataaataaaccatgtgttggcattacacttaattggggtttctttacaaattcacatttgttcattttttttcccagtcatttttagttttgaagtcctgtgaaacattttgtattttattatcctagtaattttttaagatgacaattgtaacaattataattttaagaaaacagactagatataaggaattaagaaaattcaatttagtatcttaagatatgaaaaacactatttccctcattatcttttgatatgagttttgaaagcatatatattatatatttttcatatgacatatagataatcaagtataataatatagtgaacactcctggacctaccaccacgcctgataactgaatattatcatttttggtctatctataaagtctttcctatcttgtttccatctcctttcagatgtcataggtaatcagaattttgtatttgttattcacatgcatttttatagtttgaacacctaatgaatgcctacaaattcttgcttttgaaatttataaaattggttttatactctctctttagcactcaacattgtttctgagtcatttatgtgtccacataggtatacattttcttggctgtgtagtatttctcttctcttaccaatgatgtattggttgttcccatgttttgcttcaatgaataagactgctataaacatttttatacatttctctaaatacaatgggcaactgtaactgcttttccttgtctttaatcattagtttgataccactgttaaatacgttattaaaattttaattcttaaaagttgttttaaagaactagcatagaaacaggagaaaaatatgaacatcttacccttagattcttgatttctaggcaaatagacaaatacaagtcttggcttttaagagtctaagatacgttcatctttttttttttttttttaacattcctagcatacacaatgccaatattgctaagaagggaaatggaaatttatcccttcatagtatttattaaaatttctgcttttttaaatatttgtttgtcctcttgtgtattgttggcttctttctctgaaacgtaatgtctatgaatcttctctgaaatgtaatgtctatgaatcttcgctgaaacgtaatgtctatgaatctaaggaccttggttctcttctttatagttgtatcttcagtgcctaagccttagcaattatcatgttaatcaatattgttgaatgaatgaatgagtgaacatgtgaatgagctcatgctgtggtgaccttcactgagcatcgttgagtcatctacatgtgcatacactgtggaggatacaaagatgtttaccatttggctcctcctcttgaggaccatatgcctgagctggaggtctatatgccctactatgccatgcttccaccctccaccttcctctattcattgctttgttactgtattaaataatactgttaactttaagtaactcttactaaaaaaaaaaaattaaaaaattaaggctgggtgcagtggctcacccctataattccagcacttttagaggcctgggattataggagggtagcttgaggccagtagttcgagaccagcctgggcaatatagtgagaccctttttctatgaaaataaaaataaaaataaaaagttagccagacactgtagctagttccagctactcgggaagctgaggcaagaggattgctgaagactgggagtcgaaggctgcagtgacctgtgattgcacctctgcactccagcctgggcaagagagctctgtctcaaaacaaacaaaacaaaaaaaaatcaatacacttagataaatatatacggagtgcctattatgtgcttggctttcttttaacacttcccatgcaactgaaaggaagcagtctttcataaaacttaacattacggtctgccatatctgaggactgaggctgctcccagattacccctcaacaactctttctattatactgacttatttcaatatgcatggttatcccctggaacttgataaactcagaatgtttccattgctgaaaccttgaatctcaaaatataacctcatatccctctagctctctcagtctctctcattaagttcaccaacgcattgacaccattggctattagcccactttctagttaacttacttgctccttacctgagccactataatgtatttcttcaaccatatttctaccaataccctgatcttgtgtcttgtattgggcttcacaaaccttgatccatcagtccagccacctcgcttttcagttctagtagctagattgctaaacactataggaaaactaatacgggtatgagaacttgttttgagctctccaattcttttattaaacagtatctattgtttacaggattttctaatatattttagatgtagaaagtgaaagaaaaataatcttaggatctagaaacactataacctgaatgtcttcaggtagtctcacactctcctgataaaaacaagcatgcatattcaactttcagtctctctatcaacttgaccgtatttgagccaagccagatttcactctctaccgactcaggggaacaaatgaacaattaccatgcttacaaccaaagaaaatatgtctaccgtcatcctagattctatcccttcctctgtaagaacttgttctacagtctcccctctttgtatgttcaactgttccctctcaattggctcttttccctcaatatatggaatgattgaaatttattttccttagtgttttttcttttgtctgtgaagcctcctccactgtacttttccttaccttcatggtcaagtgcattgaaagtggttacttttgttattgccactttttcatctcacttcagtccctaaaatgactgtacattaggttcctgcccctaccacacctttctacaaaatcacttttctaaagtggtcaatgacccccacatttcctagcccaatgatttttatttcttatattttttgtcctttttctgtcattctgtttttttcttattcttccctactgattttccaaaatactagtttctcctgatttcattaagttctcttagcttctttaaggagatcattgtcacttaaaagaactattttctactacaagacccttaaaacattggtcttgctgaggacactaatcttttcccttttctctcagtctttttacactcactgaataatcttatttattttgtcatgtattttctcctttttgctgggccatccccaaactgtgtatctttatgtttgacttcctcaaaaagagtttcatctggatgttttataggcatttcaaactcaatatatttaaaatgaactcacccctcctccttgtcaacaacaacagtcagcatttctttcaaatgcttttcataacgtgatgatggcagaacaccctcctagttacccaaaaaagatgagatgtgttcttaatttctttttaattcatctaactcatttaccttttttaccaggtcctaatgagttgcttttacaaatacttctaagattgagtcttctctttcatcagcatcatcattatccttattttaatgactctcaatatgttttcacaattaaatggatttcctaatgcatttcctgaattctagtcgagattttgttttcaatgtgtacttcttatgtctggtaggctaagcttttagtgcaaggtaatactgggaagaatatgagttttggtttcagacagacaccaaacattctttccataccagaccctcctatcactgaaagtcctttaaaatctggcttctacatagctggcaagacactacctcacctcccacctccatatgtaccctttgtcttagctaagttggtgcctttctctgaacctgatgtcctcatgtcatgcatattagtccccctccttgggggaccctccatgaatcttatatagtttctaaaaccttgctttaaacctttcccaatttccagggagcaaaaagccttctctgttctctgctttcactttactcctttcttgtcttgattgttgtattgctcccacatgtttgcctctgctactagacagtatgactcttaggagcagtgtttaccttagagcagcaggtatatggcacattgtaagagactcgatatttattgaataagtggttagacaaatgaaaaattgcttacctgaggtccttcctgaagatgatgcttttatggaaaaattcataatttttatctggcatgatttaatttgttttactcgacacaattgatctcaagattttaaatatcatatggttactgatatggtttctaacaaagtaaaaatatattaggtaaaataattatcatgagacattttgaaggaaaacctatgaacttattttttactatgaaaatttgggtgaaatatgttcacattagaaaatggtacagtcatctaatagaatacacatagaagcaattatgttagttaaagatttagaataaaaccgaaatattgaatcaaaatatgtcttacatatttgaaattgagttcactagccagttaaaataagcttaatcaagcttgacatttcattttcttattgtcttgccatattttcccccaaattaaattgatatatgaagtagtattttctcattttctaaaaattcaaagagtcatagttcaaagtgttctgttctcttcagtcattcagtcacttatgcaggggtttaatcttctaactatgttgcagcaaaagtaaaccttaggtctacataacatcgcatcacatcctataatcattagtaggtatgaatttgtttgcatcaatacaacattcttcatgtcaactataagctagaaaagtgtttcctatgttcctaagcagaaacttagggtagagtgacacatttctatagagtgctttcagggaactgttttgcttttcttcaagaaattgactttctgctctctcccaaactgcccttctgcagcctttttatatacctactttcttttttaatataaaatacagatggagctgaaaagtggaatattgaccttccggttaaataccagtcttgcctttacacaagtggatctattgctggggctatcctattgtaatggaaagtggaataaagtcattattaaaaaggaaggctctttcatatcagcaagtgtgaatggactgatgaagcatgcatcggagtccggagaccagccactggtggtgaattcaccagtttatgtgggaggaatcccacaggaactgctgaactcttatcaacatttgtgtttggaacaaggtaagttccatctggaggaattcacaaatccatacagccctggtgctaacagtttttggtggttctgtgtttcaagagatagcaatagactcaggctaaaagcagcacccaacagcatctctttttctggagaaatttaaaccttaaaaactaatgaaaacactttttcaaagagttttgtgtgttacccttaacaatgtgccatcatttataatcagcatatttatttcaatatgtcctcagtaaatagtaattaatatacatattattattaatgtgacatataattatatatgtggtacataattatatatataaattactatttactgaataaatatcaaaataaatatgttgattataaataaggtaactgaggtgcttcccaaagatgatatttatatggaaaaattagtaatttatatatttatttaaatatgtaatgcaattatatgtgagatacataattatataagaaatatatgtgtgtacatacataattatatatataattatatatataatgcatataaatgtatttcctcatatgttggataatgatcattatctgtatttacagatgaaaaaataaattaagttggtatgcataactagtaaaaaatatcaatgcaattcattgccttttctttctttgacataaatgctaattgtctccatagtttttcagtagagctttcatgtggaaaaaaaatgtggggtgtatgtggttgacttccaaacatacttgtgaaaatctatatattgtagattattaataactataagagaaaggaaaagtgcattatttacaatttaggtgagaagttaactcatagacgtttgaatgtaatcagagaaataattaatttgaaaaggctaacaatatctgtgtatcatttcttgtggcagtcatggttctgagagcttacatgagaataggtgagtcaattattcataacaagtgtgttaggcattattatttatatcctcattacagatgaggaaactgaagagcagagaggaaggtaactttcccaaggtcacatggctagtaagcagatagcaagacactaagtctctcaggcagcctgttataaagtcaactctcctttttacagtcaatgctctcttttatgggcattggtcaatgctcctttgtaaagtggggaaagcatagtaacttccagcataggaccaagcaccctcccacgtgtgaaaaaggtcctttacgtatttcaaaatctacataccctgaatggttaaaattttcatgaggcaatctttgcctatttggtaagtacataaagatttaaatgcctttgaatagaaaatatatggcaagctcttaggagacttttagaagggtagtagtaaggagttaatgaataactggggtgtaagacagtaatgacattttcaaggcacttaagatgtaacagcagctaaaaatattacattcatataagagcttctccaggttttcaggtttctgaggttagaaagaacttgaaaacccttcgtatgagtgagattacttaatcctgtttgcttctgggaaaaaaaaaataaaaacaagaaacaaaaaccctgcatgtacagccttgttctttgaattacccctaaacccattactattgatggtcctaaagacgtggctaaaaccaaaattgtaagataataacagaagtttaaaacatcaccatagacccaaagggaataattttacctacacactatgactaagtctgtgatactggaagatattttattagtgagtaatattaaatttttattactgtagtatcatccatatcagtggtctcaaaacactgaaaaaatattgacgtatggtagctggaacgtagaagtcaaaattagccattatttttactattcaagatacattgacatcacctggaatggttattaaaaatacagatgttagggacccctgtcccctaagattctgactcagatgccttgagagacactgatctatataaatagctgcatgttttatacggtgatcagggagactagtcacaatacagaggtgcagcatgtatgtagtcaattgcaattaaaacaaatcatgttcatttaatgtatttctttcaacccactatcaattgtcttaaaaacgtttttccttttctctgcttcttaattagcaccttttttttttcatcagaagctctattttgtggtcatattagtgctattttttttttaatctactaacgttgcaatcttcctccgaaccagatacaagactaattttctttcttgttttgaaaatgctgggcaacataatttgctgaagatgtgccagctcagatgatgagagtttatcttcttagaatgatcaatgaggataatcacttacatctaggttgggcatgactgggtctggcatgtggtctcacaggcaatgctctgcccaaacccctccatggagagggagagagtgggggctcaaatttagcaggcctgccaagccaagcactctgcagcagtactgccttccctagaggaagggctaatgtttttctgattagtcatcttagagctctgggccgccttttaggcatttagaggcccaggggtggtggtgtggatggggatttttttggattctcacaagggtagtggagtaagaaaagaaagcatttccactcctctcgcaaacatcccctttctccttttgttgtcctcgcatctcattcaaatgttttaggtctggggagcatttctggtggtacagagttgaaagcacgggacaaccttaactgaactctttggttgccactggaaggaccctgcactagagctcagcagcttcaagagctcagcagtctccaaggccagaggccagaggaccatttccttaggaggattagtgcttacaaacttcattttataactaactctctaggcctttttcttcatctccaaaatgaagaaagatgtatctccctgggctttcccaaattgaaaatttcatcttgtgaattaatttttatgatgttttttgctaaatttttaattttttaaacattatggtaaaatatatgtaacatgaaatttaccattgtaaccatttttaaatgtacagtttagtggcattaggtacattcacattgttttgcagatatcaccaccatccctctgaagaactcttttcatcctgcaaagctaaaactatgtacccctcaaaaaataatgtagcatttcttataacagcacttgtttgccaagctgccctttcactgttctgattttgttggtagggaagttagggtacagagaattttgataatacagttatgtgccatcagaaaattactactgataaatacattaaaattcttagcttctgaattttccagccaatgatttcatattgagcttcattgctttcaattcaattcacccaacttattgagtgtctactgtgtgtttaagatagactagcagtattgatcagtcaggactaaaaaaatgtggataatagtaaaagacatttaaaaggaaataggctgcaacttaatgtgttagaaggcataataagacatcatatgaatgctgaggagaacaatatggtcattgttactattaacttattttactgttatgcatttcattatattttatttccatttcctgctgctgtgctttaatcttgaaaagagctgatcatgtgtttgaggcctttcaaactttacagtgttttgttcggagagagagagagagagagagagagaacatgcacgctacagcaatctcaaactcggtcctgtttgtcccaatttcgtgcagttttctgcgcagagtactgccagacttcactgagctgatctctgttttcacaaaatagcatgtaattcaaagccactgctattccctggctaactggatgccttttttgtttgctgtctaacaaaaaagtggtgaatactctaaattcatttcatccgcattctctgttaaacttcacagaatggtactgcgcagtgggtgttctaaggtcacctgtgcagaatgcacattccatgaaatctcatggtgttgctattgccaacagtgaaggctggcccctgtcatgctaatggggatgtaaaactggtgaccattttgtatgttcaagattatggaactctgtgaaaaatgatagagcatagtgacagctcttctgtaggctgatgtaactcgggctaaattctatacctctgaagtgatcattatgccattcatggcaatatttcaggactaatatattttgaaattatgttctctctcctggtattctacataaaatgctcagagtgtatttttccccaatgagcttactgaataatcatgctaattcaaatattattttttggcacttaaaactgacttatatagtaacttaatctttcagaattaagagacatggggctatccccctaccataatatgaagttgcctaaattttattttatgggaagaagcggaatttagaaaatgtgggcctaaggaggtaaaataaatgctttttcagtaccaaaagttaaattagaattatccattaatgtgttttccaaataacagaactatatttctttgcaacaaattagcttgttaaaaagtaggaggcataaaaggttttccaaggaagactcgaaagtctagcaattgtatctaaccaccccccttcctcaaaatgtagtgctgcagaggacaaaaatgattggtaattaatgactcaagccctttatgcgatactaatcccttactatttgctaggtttcggtggttgcatgaaggatgttaaatttacacggggtgctgtcgttaacttggcatctgtgtccagcggtgctgtcagagtcaatctggatggatgcctatcaactgacagtgctgttaactgcaggggaaatgactccatcctggtttaccagggaaaagagcagagtgtttacgagggtggtctccagccttttacaggtaatgtggaggtcctctaaattaaatgttacatgtctcttattcatccccctttccctccctgccagcccctcattaatctatatgagtattattttaatcttgctgcatcttatttccatttaagaatacctgtatcgagtgatagcctcgcatgaaggaggttcagtatatagtgattggagtcgaggacgtacaacaggagcaggtaaatacttatcttcaaatgcatatgtgcacacacacacatgcatgtatttgtgcatttatataaaaggaaggactattaccctgaagcagtaatatttttgtagtcttctgacagagcatgccttggtttgaaaatacatctgtcaatggctaaaatgcttagtagatcagtgcttttcatttaccaagaattcactaaatacttgctcagacttgatcctttcctcttaggatgcagaagtaaggaaagttcaggttgtcttaaggatgtaatagtcccacctacctaacatgtctaaggataggtaacctttacagatggtgtagatagcaagaagctgaagtcagggattaggattatccttggctgggagtggcaccttcttgactttctcacagaaagcacatttgaaacctgcaactggttggaatcaggggtgtctatgacatcattgcagatgtttgccccgttgttgactattagaatcttagaatgactctcccaagagagaaattgctgattggtttaatatattttgaattggaaaagaaccaactaggagacagtatacattagacctaatctcagacaactgacttgttttgtacttctgactggccacaaaatcttttcccaaaataccaccacaggaaggcattcagcacaaagagttttgtgaatcagtgacattctactattttgggtcaaatatttgtcaggaaactgaacacatctccagatgattgccacttatgtctcagcaaggaagtttattcagcgagtatcaatttgtctaaagacgtgtttccatcaaggtattctcttatacttaatcaacagtaggttactatcccaggcatcctttgaggaatcttcttaatctaaaatataattaaatactgagatgagcaactaagaataattttcaagactctctacctacatattttccagaagaggacaacttgacacttttccaggatgatttaaattatcacctatttataggcaagacaatgagctgaacgatctcttaaaattcttttcaacttcagagctaagagaaagctccaatataaaatactcacttgttactgacatgttctctgctcctatttcacactcttctactttattaacaaatataaagcccgctttgagtataattcagcaacattaataggcgtctggaaagcacattgcttacttagcttaatagtccccattttgagtactactgagaaagtacacaaatagagctctgaatttatagcaatgatctgaccacagccctatgccataaattcatatttacaatctgaccacaacactgagcagctacatgctcccaagggttggagaataattgcactatttaattatttttgagtcagttttgctctgtcccttatgagaagaccatctgttagactgtactgtactttgccctgtaccacatttccgaactaataaaatcagcgtcactcccattgtccctttccttgcaactcgatcttgtggcctgtgtgttttctataggtgtctgtagtgttttaactgctcagagagtggttctcccctttggtgtttcctcttatcttttatgttcactttgtttcccttaaagctgtcctactttattggtctggacagtaaagtcggagaggaggagatttgatgtggaaaaaccagagtgatcctccatcgacagggctcaggagtccatgagcagctagagcaggtctctcatccatcatcctgccacggagttccttgggctctttctttgtgtccccagtgcactcagctgtgatgaagtttttactgatcagaactgtagaaatgtctaataaatagttaaaggtaatagattttttaaattagggggctcagcttgtaagtaaggttttgcagttcttttaaacttcctcattttgtgatattattttgaaatattctgcagaacaagactttgaaaatgactttgtagaatctcaaaggcaccagctcctttaccccacccccacccccaaaaactgcaactaagaatatattccatatatcatatctggtagaactttgctttttaaaaattaattagaaaaacaattgcatttggaaaatgggtctaggcattcaagtacaacacaatcacatttgtgattttttttttggctaatacatcgaagatataaaagtgtcaaactactatgtataataacagtctaattatcttgcttcaaagggggtacatcattatattgcttgaacttgttatctgcctaccatccacctccttctttatgagtgatgtttaaacatgtctgatacattaaatgtttttggaaaacctggactagacttgaaagaatgttatgtcgatggagttttgatggttttgaaatatcgcttaaactgaatggctcaagatgtgcagtcatattaaatcaatgctgaaaagttacaactctaataaattgtatttatgctaatggttgagtctgatttactgcggccattaaaagtgaagaataggagcaatagtcttctcagaactgccattttccctattttctcttttattccttcacagctccacaaagtgtgccaactccctcaagagtccgcagcttaaatggatacagcattgaggtgacctgggatgaacctgttgtcagaggtgtaattgagaagtacattctgaaagcctatagtgaggacagcacccgtccaccccgcatgccctctgccagtgctgaatttgtcaatacaagcaacctcacaggtaaatgcaatcctttaacagagtagaccctattaacttcctttttgtttgcattttaaataaaaatcttctgcaaatgttttttagaaaaatgtattaaatatacatgtattttacctgattaaaaacaacacccatctaaagtagtggaagcctgcatctacctaggataaaaaggataattctacaatgcgcatgggctctcatggataattttattctaaggtagatattctctccatcccccaaagattacatcataggtggctatagccctttaacaccttatagacatcttttggaaatcctatgtataaatacttatttcacaaagcaaaaatttactctttgggactagccccagttcataccactattatttattgtaaaattgctgattaaacctaattatctcaaggtggaggagtcttagagccccagttagttggactggcaaatcagtgaatcgatttctcacagtgtggtgtgccatgaagaatgattataatgaaatatactcatacacaccactaacacatctcacactcaaattcatgcgtgtgtattaagagcatttttcagcttcatgaaatattaaagcacatttaaagggagagtttaatttaagcctttgataaaagggaagtaaatgtgtcaaatttgacagaaaaaaaacattttcctctatcaaaaaatcctataacgtgaaccatcagaatggacgttagaaaagccttaaatattttcccaacaaacctgttggtcaattccctcaagactttacttccttctttagacactttggaatgcacagcccaaatatactaccaacttttagcaaaagaaaaacaaattcacacccttcacttctttcctattttaccctccttatcaaagcccagcctgagtaagcccacagcttgccttttcacaggttgcatatggcagctacatgggctggaaaataccaagtagtttattgctaaaaatgctcaaccccactttcagatgagcactcagtaatgacaccaaccctactgtatttccagaatagctccttcccccattctcctcattaaatattttatatttttccaaactatacacgttacctccctttctcatcccactcagctgacagcgttctattttagattatattagacaccatagaaaaaacaatttattttataggatttctattactttcttactaccaaatgtacatattaattgcatttttctgcctgatggagttgttattaggggttggatgaatgaatgcatgctaaaacacataaaaccattttgatatacaggaggtgtgtgctatgctataattttattttcattattatttttaattttcacgctttttttcctttctgttttacaaagcttctcttatcctatcaaaaatagaaatcttcacaagtcctctggaccctgactctttctgtttcttcagagatattactgatagcttatcgtcctctcacttatatttttaacgcctctgtctgctgcagtagagtatggcccaaggaccagcattactagcttcacttgggaacttattactaatgcacattctcctgccctgcccaccccacacccgccaaatcagacactctgcagtgtggctcagcagtccttgttttaacaagcccccagatacatctgatgtatgccagcatttgagaaccactgactgggtggattcttcccagggtcattcaaactcttttatctcccattgttaaaaaccaacacactaacccaaaccaatcacaaaaatcttaattctgtccaaactcccagctattgctccctctctcctcctctcggccttcgtctagcatgaagtatctaagctcattttgtcctcacttaactggcttctgctcattactttcgtgacgagcaccaaaaactgccatgtttacataggcaaaaaacacttgacactctatgtcttcaccactcttcagcattctccacagtaactctttcatcatttctagaaatatttcttcacttctgtgacttttctgcttacctcctggttctccaggggccctgttctcagtgtcctttgctcacttcttctaaagtgtgacaaaatattgaagagtctcaggatttagaactgggccgtcttctctttctctttcatttttttctggcttgctccagaagccttattgactctcataacatcaaataccagatagatgctgctattgactcctaattgtacatcccacctagacatccaaatgcctgcatccaataggcgtttggacacaatgacatttccaactggatgtctctcaccttctacccataccaaacctcaactcttgcttctcctgcattctcatagatacctccagccacccagtcaatacaatttgagagttactctggacttttcacctccttcacacctcatatccacagttgtcattctatttttcaaaatatgtgttaaggtcatccatttctcctctaatctactggccagcccaaactactaccatctttttcctggacaactgcaatacttaccttcatctttttcatagccttttttttttttttctctccctggccgtgagtgtattctacagagcatccaacatcatgtccctctcctcaaaaactttctttcttttttttttaattatactttaagttctgggatacatgtgcagaatgtgcaggcttgttacataggtatacatgtgccagggtggcttgctgcccccatcaacccggcatctacattaggtatttctcctaatgctatctctcccctacacacaccctccaccgctcgacaggccccgatatgtgatgttcccctccctatgtccatgtgttctcattgttcaattcccacttatgagtgagaactcgcagtgtttggttttctgttcctgtgttagtttgctgagaatgatggcttctagcttcatccatgttcctgcacttcctctctcacaatcacactttgtctgggtctccccctacttccagggtttccaacaattaccgttgtaattaatataatttaaagaaatttgtatgtaaatccttaggagaattcctgacaatgatgatataataaatccctagcagtggaataactgcatcgaaggcttttaagacattgtatagtcttgaactttgaagtcagacattgatataaatctctgctatataccttccctgtggataagttccacatccttctggatcctaaagtcctaacctatgaaatgggagagtgatatttacctcagaagaatattgaaaatattaagtgatatgatattctagctctaaccctttttagctgtgtagcttggacaaatcaataaacctctgtttgctttaaaatccttctaggtaaataagaatgagatacaactacatgcctcccagggcagctgtggggattaaacgaattcatatgtatgtaaagcacatagcacagtgcttgacatgtggcatgcactgtatcaaagttacctacaggatatctgtaaagtgtgtaacattatgcttaatgcttggtaatttctcaagaaatggatagcaattattattattattattactattattatttaatgaagtctcactctgtcgcccaggctgtagtgcagtggcgcaatctctgctcactgcaagctccgcctcccaggtttacgccattctcttgcctcagcctccccagtagctgggactacagacctccacgcccgggtaattttttttgtatttttagtggagacagggtttcaccatgttagccaggatggtctcgatttcctgacctcgtgattcacccaccttggcctcccaaagtgctgggattacaggcgtgagccacagtgcccggccaggatagcaatttttacactgcccaaaaagctgtacaaattatgcttccaccagcaagcagaatgcaagattgtgcatttcattttatctagccaacaccaaggtttacacttgaaaaaaattgcaaatttaaaaggcaaaatatatcagaatattgttttagtttgtatttatgtgattactagagagattagttttttaatatttattgaccatttctacttcttttatgatgtgcctaggtaggtccattgttttttattttttattttattttatttttttattttttgagacagggtctcactctgtcacccaggttggagtgcagtggtgcaatctcagctcactgcaaactctgcctcctgagttcaagagattttcctgccttggcctcccaagtagctgggatttcaggtgtgcatcaccacgccagggtaacttttgtatttttagtagagatggagtttcaccatgttggccaggctggtctcgaactcctgacctcaggtgatccaccagccttggcctcccaaagttctgggattacaggcatgagccactgcacccagctgcattgctaatttttctattgaatgattcacattttctcattaaagtttttctctgcatatgaagaataatatacatgtttatctcatctaatgcaactcccccagttttgtcattttttaaaaaattttgatttgcatttttgtgtagagatttaaaaaatattttatgtagttaatataacacccttaaaatgttcaatattctatgtgtgattttttaaaaatatatattccccatttagggttgattattgtttatgttagatataccatattgataacatataatgcatattcctcaaaatagtaattctaaggttaggataagaacaaatcagaaactggatgcagggaggcttttcaaattaaatcagcctctcccaagattctgaaggataccttcttgaaggcgagatcccacagattgtaaaccaatgtagggcagtactggatgttactcaaaaggcatgtcatacatggtagtgatgtatagggagaagaaaatcagaaaactgttgagcaattgttatttatttttatatatcaaatttgtcacaaactaagggaagagttaactatgttaactatgcatgcagttttgtcaatttctctgagatttttttgtttgaattttttgagtttttattacttttacacttattatttatgttttaaccttcaaagtctcattgctttaggtacagtcatgcattgctaaaggatggatatgttctgagaaatgtgtcattaggagatttcatcaccttgcaatgtgcttacataaacctagatgacatagcctactccacacctaggctagatggtgtagcctattgttcctgggctgcaaacctgcacagcatgttactctattgaatagtgtagggaactataactcaatggtaagtatttgtgtatctaaacagatcaaaacacagaaaaggtatagtaaaaacactgcatggtaatcttatgggaccaccatcctatatgttgtctgttgttgaccaaaacattatgtagcacatgaccacatggcagcaacttggctaacatcctttaattcaacattgttttcttataagtttgatgagaaaattaaaaaaaaaaaaacaatccctagcaagggccactctctgcatggaattttcacattttccccatgtttttgtgggttttctctgggtactccagtttcctctcacatcccaaaggttttccccttacatgaattgagttgtctacgtgaccccagagtgagtgagtgcaggtgtgtatgagtatgccctgtgatggtatggtggcctgtccagggctgattcctaccttgagccctgagctgccaggatgggctccagccacccacaaccctaaagtggaataagcagattggaaaataaatgaatgagtaaatagaaatcattataaaataaaaattcataaagtctatgataatcatacagatgcacagcaataaacaattcagtatgacagggctcagcaagctgcccagtctgtgattgctggggtttgaacttcatgctggtaggcggtgctccttacaatgttcacttggaaagcatttattccttgatttatataccacaccactgtcactcactgattcaccaaaacttgagtaaatcattatttcgttttgattaatcttttgtaaatgcatgtatagcacacattcatttcaatgtttaatattagtagtctatagaaatttggtgatgttttgtgaccagaaatatgccataggatcttaattcttttttacatcaattagcctgtgggaaaattgggtttgttgtatatcatttcacttaaaagtgatagtttacaaaaaattccaatgacattaagtgaagacttctatatatctctgcagttttagttttatctttcacttgagattctctgtatttaagtacgggagtcactcattcatacttgtttttataattgatataattggtcttctctctgccatcatgttttatgctttccagttttattatttcttgttttttagtgattttttcactacatttcttgccaatgtgtactatgaattctttgattttttttctttcaaggagtttgcttctctcaatgctaaattgagtcatcaaggacataggtagaaggtaatcttaaagactaagaagaactccagtattgccaggtggacttttcattgtgaagactcaggataatgaggagggaatgtgaattgagagtcaccaaagccagcttggataattatcaaagtcagagaatttcccagtaaacaaaaggaatactaggaagtgagatggaaggagctgataaagcagagagccagaaagctggatttggtggagacgttaggggtgcagagattgttttgaggcagctgttttgccagttggttgagaaaccaaggtaccaaaagagagaaaaatcggtgaagcctatataaacagttttgctattgagcagttttgctactgatcttgaaaataacccttatttagcatttctgaggtgacttttgttgagattttaatatttaagttaattttggttgttagagtcatatttaaataaaataattctgacactgaatgtacaaggcaatttcgctttattagttagcgtagggttctttaccaattaagtttaaaaaatgctaatcagaaaatgtgctgttttatttcattaattttttgttgtataataagctcttttattcttcagatttgggtctttcttcagcttggaaaatttgccattgtgtttatgatcattacttctggtgagaaatagcaattttcaatattgtatatttcttcctaggttgtcttcctcattttagtagttcagaacacggcttgtagagtcaaatcaatctaaggtcaaattccgcctatgccactttttagctgtgtgatctcagacaaatttaaaaacatatccttacattggagtttcctcattcataaattggggatgaaaaccttatttatattatggaactgctataaagattaaaatgagttatgtaaaatattttgctcagaaacaggcacatagtgagtgttcaatgaattcatagttacctttataatctctgaattacagtttctgatttctgggttattgtcccataattgtttttatttccattttctgatttttgcactgttgattctgctctttgaaacttctaagatgatttttaattcttctagttcagtctttgatatgatctgcctttttcctcatctagcttgctttgatttctgcctgcctcttgaaattctcaatttttgtcttcatctcttgtttactgcttaccttctgtctcttacttagtggattccaagttattttagatctaattaatggcatgcaactcgtgatttttaaattttacaagtttcttgaattaaatcctccccagaatatgacaatcttccataatttgagggctatatccttatccttctttcaagttacaatttttccatcagctaaatgtcctcccccaaactcaactccatagtttagttggctcatctctaatataaccttctgactgggtgtttgcatgggaaaattaaactgttttcaaatcatcttactgggcatccagttgctgttaataaaagcctttgctaagatgatgacagggttagtggggtaagtttgcattagccgcgcagccaccctacagtttcagcttctttcttcccagtgtttggtagagtaggagtgctgagagcttgctggcattttgcttccagtttaagtttgggtttgcctaggactttccttctaacagtccattgtctctgcctggtctcgttttaggtatttataaaactttggtcgtttcactgggattcttacaaggtggtagttcaaaactatagctgtatactgagtcaactggggagctttaaaaaatatactgatggctgtgtgccccacatgcaaaatgtctgattaaattggcctggaatgtggcctggacatttgtacttttaaattatctcaggtaattctgctgtacagccagcacagggaaactctatttaaaggaggagtttgtcaccagtgatcacatttaaattttatccagatattcttataactttcatttccccactgaaactcaaaaatgttaggaaataaaaaactaaatgtatataaaaaataataagctattaaaagtaaatagaaaatactagcaaaggaatatcataagatgacaaaaattaagtgtaatagttattgggaagtgggattttatgttcagacttacaaaaagcagaaggtaaaagcaaagaaaattattaaaaatgaatatcaactaagataactgaagaaaacagaatagtgaagcagaatatttaccattcatgaatttgtctatcagaggattaaatgagataaatcccagttgcaatggagagtccaagggttaacaggcccgctcaggagcaaatgggcccctttgggccacagggtctagattctgtgccctcccaaggccaaggttcagagcaaggagttctttaaggttcattccctcagccagagcctcagggtagaaaacccttcagttatcactcctgtgtatctttagatttgttgaaagggctccaattaactctgggtagcttttgctgatttttcctgcagccctgttaacatgcaaagctgcagcccagagagacaggactggcgtttcccctcaaactgaggactgctcagaaactgacttcataatttgatttgaaattatttcaagaatgaatggattcaagacttcgcacatatacgaattattttttccgtaaggtgtttaaacatgtaaacttaattatcagcataattactacagcacctggcatcaagtgttacagatataattggtgtatacaaaatattttctcaattttattgttgcattacattgagctaaagtctaggggttatattgcttcttcaggtaaaatgataaataatagtaatatttcttactatttgctatagtttggcaaatgaatcaataatgataagaataatcttccagatgactcacatatatctacatttatgtaaagaaaaagacattttaatttataacacaaataataatatagcttttgccactaaaattgtttcagtctttacatacaatggacttaatttttttacctgaatgaagtgggtttcatactgaaaatctgcctctaatttttgcctcttttacatggctactgtaataattagtgactctcaattctactggtcataaggtgattctcagattacttataaaatgcagatttgggggtcactcacacatgattctgtacatctgggctagtatttagcaatttgcattttacctaatgctccaattgtatttttggaaggtttatgaaccacatattgaaagacactagtgtagaggagtggtcagcttagactggaatactttcacctgctaggcttgcaactatccctgctttattcctgcttctggttctgactgtgttagctttgctgccagaaaaatgccaaggcaagtgaagaaagagaggcagtgtcagtaggacccctgaaccccagtaggactcctgaacttctgaaaattcccagaagaaagaaagtaagaattggggatcttgataacatggattctgattcactaggtctgggaatatggtgttagattctgcatttccaaccagccccctcccactctgtcatgccccatatagaaaggcaaggagctcactatttatatgggaaatggaaaacaacaacaacaacaacaaagaaaaaacagtaaaataaaacaaaacccaattctcaattacaagatgccccttaggttcatataaaagtgagagcagtataattcaatgtaggaattatcattgcaatgtcttggtagagccttgcctgcatgcatttaagttacaaacattcaactacatattttggaaatgggtaagggatggaggaaaaagtaaaaaagcaaaaattaaacaaaacaaaaacctataaaaatagtgtcataggcaaaggatgctatccagtatggaaaatgtcaacatctgttagctggaaagaatgtttgaataattttagggtttcccagtcattgacaaagaagtgatactcattgtttgggtgtctacaaaaagaatgaagacttcagagccctgaagaatcattgatttctgaagagttagaggcatacacaaaaccaaatgtactatactttatgggccatataaagagttgtcaagggaactttaaatcacgttatttttgccttatgcctgattttggaacttaaactcagctatgcagagtatcatcagtaagattaaattaaattaaaatgctactctatatatgtatgtatatgtgtatgttatgtacgttcatatattatataaatatgctctctctctatatatgtattctctctatatatatgtaaccatacttacctgagaagtctgcagagaaatgactgtaattcaacgccgtgaaatttttttttctattcaactgaaagttcttactccatagttgctaaaactgcctatggtactctctgtgcacccatgctatttcttcaatagacaataagctcctggaggacaagtttcatgtttcatatttattttaagcctcgttcactaccttgctcaaggtaagtgattaatatacttatcttaaaagaatgaatgaaggaatctttcaattagcaaatgtagctttctgctactaaccccatagttaacctaatgttaatatttttttgtgctgagttggactgagtattgaactactagtccttactaaagtctcctcagtcttttatcaacagttctttaattttatagaagaatgcacagagctatcacaacttaaatgtatatttggaacttaatacacatttcccaatagaaaaaaaatatgttggtagggtaagactaataaataactaataaagactaattccaaaacttagacctcagaatagaacccaaccactacatatttgaaatgaaaaataatggaagccaatactgctgcaatgctgataattataaagaacagaaaatattcatttatttaaaaaagtgatctaccacgttccatgctagtgctaggccctatcattgtaacatgatttttataacactaaaatatagcccaagcactctctctgaagtataagattatgtagacaatgaaagttttatagggaaaacctaacagagatgggtttatcatttttaattcattatttcacttgagatactgagaacctaaaataatagcgatgaagtttttctctcactggtaataggtgtccacagtaagtcaatgcagaggcgggatgttcataggcgagacccacacacttcatctttttgctgtgtcatccttatggacaaggcttctacctcatagttcaagatgactgcttgagctcctgccatccagtctgattttcacccaacaggaagaaataatggttaaagaatactcacattcactttaaagacatattttagaagttgttcctccacctctggttatcttgcgtggccagaacttagtcacatggctgtacctagcttcagggaatgttgaaaaatgctgtctttattccaagtagccacttgcccaggtaaaaagtgtttttattttactgaggaaaaggagtataatacataataaggagcaattagtaatctttgccacaataggaaatcgtcagaagtaaataaaaagtaattctttttgttggtgttattaaagataaaagccagtttttatagtagaccataaattaatattccaatatttgtagtttattacgaacttttttttttaatttgagatggaatcttgctctgttgccgaggctggagtgcattggcaccatctcagctcactgcaacctgcgccgcccgggttcaagcaattctcctgtctcagcttcccaagtagctgggactacaggtgcatgccaacacatctgttttttgttttttgttttttttgtttttgtttttgttgttggtatttttagtagagatgggatttcactatattggtcaggctgatctcaaactcctgacctcaggtgatccacctgcttcagcctcccaaagtgctggcattacaggctacaaaatatttctttaaatgtaaatcttgaaagaaactggtctgaaaaaattcacaggacgaaaatatggcctatgacataaatagtaaaaatagaaatgatgtaatgttcctgcttagctaatgtagaaagatttcattaggtaatgcagtgttgatgagttaatagctttgtctaactctcctgaatacataatgtgcctgaactactggtacattgtgaaatcttcagagagagttgttttttaaaaaaaaaagtttttcattttattttatgcaataagaattgacaccaaaggatttgcatttctttttggtaacatgttgagccgtagttaaaaatgatgaaaatatataacttttgttctacagtgataatcaactaggcatgtccacaatgcttataaacattcaatacaaatacttcaaggttatcaatcatagttgataaagaagaagaatgcacagccagacttttctgttttctaccttttatgatcattttatatttgtgttatatttggaacaaattaaaagggttatatgtataataaacaaaggtccaatattgaacccaatctctctctctcacacacacacacacacacacaaatgcacacatagaatttcttataaatcagtcatttttgtaaaggaatattacaggcatacaaacttgctcattttggaggacaagacttctaatttctgtttgtaagcaataggtgtcagtaataaatttgaacctcttaacacattttaaggtgcattttaaataagatattttatagtaaaaagtgtgctattattgtttttaattaccatttttcaacacttttttcttgtttgtggaactggagcttaggtcaaatgggaggagtaatgatcttggggtcagaatacaggttctaatattggctctactgctttttagctgtctggacttgagcaccatacagtacactcactccaaaagcagcctcctctgtacaatggaataacaatatcagaggcttgtagcaggggaccttggacactgatcataagggatgactttcatttctctttcttttcttttcctcttgtctccttgcctgtctctctgcttagtcaggtccagtgttttcttgaagagtttcagtaatttcagtgtgagacctttatgtaaggtaaagagttaacacaagcacgtggcttcaaacttattggcaaattagaataaaaatggcaaagactctgtagttcttaccacaaaggcattgattaaaaatttgaggttagaggtaaacctgctgagagaatcttaactggataatactttgaggtcaattaaaatcactgtttaaaccgtcctctaagactgggattagaccacatattttataaagaaataaagaataatgtttttcctgtttgtaagaatcaacatctgcatagtctttgataggtatatgatattctatgctctctaccaaaagttttaaacaaggtcaaaaaacccatttgaaggaaattaaatgtaagaaaaattagttttgaagtttccaagggattaccttaggtttgggttaagtgtatttattgttccaccttttgggtaaaatgcaaattgactttccctttgtaaatattagaagtccttatttttattgaaaatattatccaaaaacaacaataacaaatcccaccctcctgggctaagaaccagaggagaagcatcctggatatgtttccagatctctattagatagttaagttttcatccatatttaacaaatgtcattattcagtttcatgggatcactgtgtcaaaatgtctgtgttagaactttattttcagaggttcctttaagtggtcaggaagcatggcatattggattgattactctctttaatccatccactgggttggtttgggatgtatacttaaaaattagattttatcagcactgcagcgggatcctcagccagaagtctcttcttctgccctccttcccctagccagttttcttttaaaaagtgggctcttccattatgtctccaggtagcagtagcagctctgcctgtgtggcatcccttaccagatggccctcttaataaatgtcttgctcttgcccaccctcactttcttgatccaaatgtgaaatgccagcaaataaataagagcattgtactctgatgagttctcttgagatgggggaaaaccctggggagaggaagctagaaacagcttttctgtttgctgtgactgctcctaattactggccagtagtagaagatatcatttagatgcagtagaatataaagataaagaaaaaaaaatgagagataaattctccatgttatcccaaatgcctttgctaacgtggaaatactcttggattgttggagtgcatttgaaatattgtgcatgatccttacaaggggacccctgactttggactcagggtagacagttgctgcatgcagatttcaccgccagactaaaagtgcaacggaaatgagtgggtgatgagagcagagcagccagttctttaattgaattaaaagctgggtgacatcaatgcagacacctgtccaattacagacaggccaaggtgtttaccattgctgtacaagcgattcgaagatgacagaaatctttccgcccacagattaacataatgaaggagaacagattacagtggatgccggccaaacaccttggttggcagctgggggtggggtgggggagggaggaggagtctgctgaagtatgtaagtagaaacggagtccttttttcttctctgaaatatgctcggctttaaaaaggatccattttgctttgtgtcttaggctcggtttccaggcagagcatttatacttgtctgcatttagtcagaggagttaatcataaaatttcaacgtgaaagcagactcctctgttgttttgctgcttctcagcatacggtgtcccattagaggtgcaaaagcttgcagagctggtgtcagctccacaatgattttgtcttaggtcgtcaggctgcctccaattattaatatttttctttggctcctttgaaacttgaggttacagcaaaggaaagagagtgttggagataataatgtatcagtcaaaagaaacaatgtctgtcactttgcttgttccctggaaggggcgtggtgggagtcaggctctcctatagtgagagaaatagccgagtggagctaacagtctgcaaaatcttaattttcagtcacccgtcaagtgctaacttttggtaaaccatactaatagctgctgggatagaggataaggaaagcagtaaaaggctatgccctctgtgttcaaggaattcccaaatcactgtgaaggacttctaagttgcaagttctctaggccaatgctcttcccctctgttaagtggaaaccctgagtgcacagagtttggagccatatgcagtaggcctcttaacctatctacggtgatgagtttccttcccttaaatcaagtccctgccccctgatctttcagcttgggctttctgcacccactgtggcccacaggacttcaattcaaagggaatctacttacttgacttcaaactcccttggtgtggcatgtcaggatttctcaatgttaggcattaatgcaaaatgcattatcgcttagcagtgagagttatggtcctgctggtgccaatgattttaatccggatacccacgctcctgtgtttcatgggatactaacacttttaagacatcaataatgcttactttatgcttattgaatgtttcttcagcttgccctcttccattacctagagggactagcaggtttcctgacatgattgggaccattttctgatttcacagagtttgtggctgaaaggcagtttgcgaggtcatctggcctgccttgtaatagggacactctcaaaaaaaaaaaaaaaaaaaagacttctctgggatgtgtcccaaacaaagagattcacaaccaaaccaattttaaagttctccctttcaggatatacttcttcagtataaaaaccccaagtgtcacaagtatcataaaaggcaactaccgcattttctatttttgggctttctgtctaggattcctttagatatgtcaattctctatttcccagtattctttttaatataataccaaaatatatatttaaattaaatttaggcttcctattatcttgaactggtaagtctgaatcttataaatgtcattgtctacttggcccgtatgcaaacattcttctttatgtatcaatctgttactgtaagaattcttctagttccaatattttcttatgttagaaaccttgtaaaaatcagttgtattctatagcaccttttccagacgcatatagcggaaacattgataaatgctttttgatgatgatatatcttcagagtaacactgtattttccagagagtacctaatctaagtagaaccctgacacttaaagcaaagccattaggataaccactcaatgatctcaaaggatatatccacaatctacatagtcttggagagaatgtgttactctctttctttggccatggcacaacttttcaacttgaatccatcctggtgaacactacttactgagaatcaaaggagataaaccacgtgtctccaacaataaaatgaccttgtcttgattccaagtgaatgaagaccacatatttgaccagccccttgcccttgcataacccttaatttttaacctgacaggaggagaaagcacagtgaaccattatagtgttcttcttcctgaagtaggtaattctaactgcctttaaggaaaattatcagttggtttgacaaactttgtctctgacacacagcatgatgaacaagattccctactggaaatagaaaagaaatggcactccagccttagaaaatgcagcacattttttgaaagtgtgatttacaagccatctaaaaccttccatctttgatccaaagttggcaagaaccaaaacatcagctttcttctttttctttctttttttttttttttcctttgttttctatttttcagctctcatttctcagggcttattattgtttcaccgggcttgaaatgggaaatgtgagcactttgataaatggcttgaaagatgatctagtttctctccagcatctttctttaagagtctcagggtttttctatgaaatacaatacaatttggtaaagatctctaccaaatcaaagctgaagaagcaagtttgctgagatgagcagtgcttgcttttaaggtccttaaaataaggagtggctaaaattaataaaagactctcactatacacatgttatacacaacgtaactcctttagtgaagacaagaaacattaaataaaacactaaagatcacttagtgagttgtgaactcaggatctggtttgatacaatccctctgaaagtctatagaatacccttccttataacttgatgtaacaattaaaatttcaacatttcactctagttatgatttggaaagaaatgtcttagtataaggaattttataaagccaggctgtaaaattgtacaatcatagagctgcttttatatttctcaatgataatacttcctgaatgtacaacacatcttcatgctaatgattgcagataaccaacctgtatatcagcattgtttctttttgggcatggtgttcctatgcctcagctgaagcatgctcatctatgaagggtgctgcttttcacatatgccccataggttaagtgatgataaagggaaactagcctcatattccaacatgcttttccttattgacattaggattaaaagtcttattctctgggggctgattcatttcttgttagcatggcgttatactaattcagccatgcaagtcatcttatttagaatcttacggtagtttccaacttggcaataggaaagacatggcaaatgccaaagatttgctaaagatagaatggctaaaacacattttatgatgataactttagttttgagcctggaatttgggtatcgtggtggaggcattacaaaatggaaaaatgaagcttacataattatttagaatgttgattcttggttggggcacgttgagtatgaaataccagtgggacatccaggtgtggttacatggcctgcagatagaaacccagaaccagggcttgggagagatgtgaagtctgtagatacaaatgtgatcactgaaagataaggcttaataagctagcaaaggcgagtgtttagaaaaagaaagaagcttgacaacaacccaatcttgagaaacaaaagctatttaagagactgtgagaggaacatgagtcagtaaaggaaacaaaggagttctcggtagtttaggagaacaactaaaaagttcaatgtcacagaaggaagttgagggaggataaggactgaggaagggctatttgatttggtatttaagggatcactgctgatctttaaaagatacaaagcgtcggccggccgggcacagtggctcacgcctgtaatcccagcactttgggaggccgaggcgggtggatcacgaggtcaggagatcgagaccatcctggctaacacggtgaaaccccatctctactaaaaatacaaaaaaattagccgggcgtggtggcgggcgcctgtagtcccagctactgtggaggctgaggcaggagaatggctccaacccgggaggcagagcttgcagtgagccgagatcgcaccacagcactccagcctgggcaactgagcgagactctgtctcaaaaaaaaaaaaaaaaaagaaagaaagaaagaaagaaagaaagaaagaaagaaagaaagaaaaagatacaaattgtctagtagcatgtagaggcagaaactgagttgcaatggtagcctaaattggaatggcatagctctgcactagagctcttgactggcaatactccatgtaagtattctaaagtcctgaacttgttcagtcttaatactaaccctttgaggtaagtactatattatccccatctcacatgtgaggcctgcaaggcctttccttcaagaccgagattattattatctgtttacagactaggaaactaaggcacagaagtctgaacaacttgcccatgtacatatggccaatcggcagcagatttggcatttggagccagcaatctggcttgagcatgggtgcccatttccccactactccattatgaagatgtgcatgtgataatgttagcttgcttttaagccatttggtggaaggagaaataacttcttaaaagaaagtaaactcagaacgtaggtcatgatctgggagatttaacaggaaatgacaatcgcaggggcaggaatgagagaaagcaggaggttctgacacgagagggttttgaaattagagagagctgaatttggcatgagatggtcacacatgtgtgtatattagttcgttggcttgctgtcttctttggccatgagctaagatgacggtgccaagtggatgaatattttcatgtagaagcatggcagacaggattcagtagcccacggagatgcctgggtcgttgctggaatgaagacttagagacagccctaggaactaagggcaagtgggaggtgtcaaagcaaagaactggtctttgctccatcctggcttgttgatcttttaattctttaaattttctactggggagggaaattatggaaacatgtatattaaaatttgtgtttgaatgatgaaagctgtcatcaaaattggcaccttaaagcaataatgtattctctgagcgattgaaggtttcatcaataaagagacaccacgagtggggccatctttttataaaaatagtcataatctatgtggttaggattaaagattgctctgaaaaacgtctttgcggaaaaacagtggtgagcaaaagcacaagttatattttggattttttttaattcacaggattaactaaataaggagtctctgccttgcttatgaacactagtaaacaaaatgtgttttcatttctacacatacttttaattgctgaacaaatctcatatatctaccagcaagccatgttaattcaatacttccacgtgtaacacttccgtttaagacaggtgtcttaattaaataaactaataattttgcaagtagaagtacaaaagcataattatctaatttgctaattgttcaactatgttaatttgcatacttgttagctacaacataaacaaatggtttgtatatgtatcgcctactgttaaaataatgaagccactcttgggagtagcatttttaaagtgtgttaataggtgccctataaaaaggactccttagttaaatacggttgaaaaatgctaggttaaagaaaattaaatagttttgtttctgcaggaggtctaggatcctggaatgagataatatatatcttagctattggaaacattgtgctctgcctcacgaactatatgtggaaccccctccccattttaatgggagaaacatcagatgctgtttgagagctgttttaacaataagttggtctcacaattttttctcatgagtccttccattcaacaatcagcagaaagggaggaaaatgactgaaagaggaatatgtttttgatttctgtctctggtctctttgtttttgtctctctctcttatagacacacacacagatatacacacaatgctctttattgatgcttatggtaaacacgcaaccctcttttgtccctttttattataggcatattgacaggcttgctacccttcaaaaactatgcagtaaccctaactgcttgcactttggctggctgtactgagagctcacatgcattgaacatctctactccacaagaaggtaaagtaatttcaaaggtcttgacttccacatttcagtcatgaataataaaataggagaagagctaaatgctacaaggccatttgctggcaaaccccaacctaatttgatgacaaagtgcattgccaggccataattgctccattttttgggggggtgcgaaaatgaatcaaactccataccctttaatgacatgcatctttaatagctgtaatgcagattaatgggctttttaattgctgttacattgttcatgcaagagccttgtcattaatatgaagcatctgaaagattaatgaaagcttcctcattttactatggctcagaagtaaatctagagacagtctgactaaaaagaattgattgtatggcacagtatgaaattgagaatcaaacggttgatttccatggtcttttttaactgctaaacagcagcacaggcaacaattatttcagtatgatgaaacctccaaatgccaattgaggcattattaatcactgcttagttccttccaacttaagtctcacttctgttgtacttggaacttacaaactgttggcataaattaaggtttcagaaagcatatgttaagaaggcagtgagaaagagaaaatattttagcacgccaaagtgaaagctttgctcaagcatcagaatgcatcacttcaagaaataacagctctcaaaacatttgaagcattgttacttcatatttctctattctggataagaggaattgtacatatcttatactgtctagttgaaaagttctttaggagatttaaacgcttgatctttagggaaaaagagtcagccagtctttctctctctctctttcccagtatctatatattccccccttcctcttttaaaccctttaccaagcaccacttgcactgaagatatgtaacagaaaggaagacatggacccataggatgaaaccaggacaggataaatgactttgtaaaatccttcttgtgacccttaatatgctgtattttttacctaaaccaatcagactcccctcacctgaactatgctgtcagtgacccagcctcagcattttctccatctggtctactggtaatagcactgtttttgttgtatcattgcatctgctgaggacatgattatcatcccctcttacaaggactttgaccagcctcaatatgggacaaatggccctatgttgcattattttctccgtatccactaaatcctttgtccagggtttacctggtacccttcataccaatttcaagctaagccccagagagatccctgctcttgtttatatttccttttttatttttaaagacattcccaaacttctaaatatccacgaagtaattctgaatttactaaatgatagaggagtttaggaaaatttaaaaaaaatgtttagttcttaggaccccccaattcattgacaactatataaaatacacagctctttttaaaaaaatatgcactaaagttttcatatgtaattgactaatttggttatgcgagctctggcaattcttatcattacatataggtttttaaaaatttatattatgaaccacattcaccagcattactcatctcagatcacaagctccttgaggctaggggactctatctgcttaatttgctttaataggtacagtcccacatagagattatgggttaatagtacttttggtggagtaacacaagcatcagtcaagtgaactagtgtaagtactcctcatccatcattgacacaaattctcataaatgtgggacagttatttaacactgttcctaaagcaattactgacaagctgcccacgaatcgggaatatttccatgcatgggatttcaggtttattccatgatttattggtttgggtctgaaaagtttgaattagaaaagtaaactaaaattagactctataaatcttttcttccacagccccacaagaggttcagccaccagtagccaaatcccttcccagttctttgctgctctcctggaacccacccaaaaaggcaaatggtattataactcagtactgtttatacatggatgggaggctgatctattcaggcagtgaggagaactacatagtcacaggtaagacctctagagttatcagcgaattgttatagtctatattcaaatataaacatacatatagttggctctcgatatccaggggttccatatctgcaaatttaatcaagaatgcttaggaaatatgtgaaaaaaataacaacagaacaattaaaaataatataaattctaaaaacatagtataacaactatttacatagcatttacattgtattaggtattctaaggaatctagagatgatttaaagcatacaggaggatgtggatagcctatatgcaaataatacaccacattgtaacagggacttgagcatccatgaattttggtatcagtagagggtcctggaaccaatctctcactgatattgaggagtgactgcacacacacacacacacacacacacacacacacacacacacacaccagataaatagagtctatagttatctgaaaatgtgtttttgaaattgggttgcttatttttatctcctgttaatcactccaattgtatgatcttgaaggtcatattagattcatggtgaaactgaagctaaaaaaatatggaaaagtgctcatgttacctccctccacccagggctgtcctactgtgtgttctcttctatagagcccaccaccccttacctaaatccttctagcaattacctttgctcagatgcagaggaggcctggaaatgcacaaatgtgctaagcacaaagagctcagcacatgacttctctgacttcagcagaccacaaggattgaaattgggagccagtgttttcccagtcaggctcacagtgtccagttggatcaatgacatcatcaaataaatgcctctctcacatgagctattagagtggtgcaaaagtagttgtggtttttgccattgacagtaattacttctgtaccacacgaatactttaaaatcctcactaatgtgtaatagtcttaagactcagaagtgtgactcagtgtggtttgaattttagatcttagaggaaacatagtatatctgcccatatcatattataaagtgtgatgatactgaaattaaatgaagtaaattcttgaaaaactttctaaatacagaagacttgcattatgtatgctgcctgtactgtgtttatatttgtattatacttatagtggttttgtatttcatattattttatatactgtatgtgactctcatgtgagacattattaatcaaatgttgactgatgaaaaaaccaaggcctagagatattaacttcttcataaaggtcataacaagttagagtcagaggtaggatgaattatttatgtattcactcactcacattaatgccaggtactaaggttgtaatagggaactggccagatactgtccctcttctcttggtgctcacagcttcatgggggcacatgtagatgctggagcaagtcgtgtggacagggctgtgtattcatccagttgcattctcaggtttacatttttttggcccccctctagtctgagaaccttaaaaggacaagaacaattacttttatattttattattcataattggatagaattccataatatttattctacaacataggtattattttacaccccaattttacaagtgaagaaactgagggaaagaaggattaagtaacccaaggtcacacagcttgagtcggaggctttggtactaacccaagcattccggctgtgttgaagaatgtggtcttaaaaacaagtgttttaacttgtcttagtttctgaatttgtaaaatggtgttaattacattttccagtattttaaagagaattagaactatatataaaatataacatgtcattagcaattggtaaagagaagttataattgttatctcctgtacaacacagagttcattgtaaaaactgaataggttaatcttactccaacagtatcttatggcatgattttaactaaaaattataaaccacagaagttatttcagaaaaaattaaatcacaccatggaaggaactttacatatattacatctttgaacctttacatatattacatttttacatatattacatctttgatgtaacatattaataattaacatacaaagcacttctgtgaccaagaggtaacattgcatgtaatgggatatcataacttttagaaccagaatagacatgtcctctgagaatccttttgctccccacgtgtgacacaggtatgccccgtatgcttactgattacctttatattacatcgctgctttttgtttgtgtcatcttgaataggactgtttgtttgttcatcggtttgccctgctgaaccataatgatcattaaggacacaactatatttgtttttttcattactgcatctcttggacctatcacagagtgggaatggaataaaaagtgttagagtgaaagaatgaagtcagatgattcctgggaataaaaacaagaagatagcaaaggggaactgatggaggataggattagggtaggaataaggcaatagagaagagagaaaaatggaaaagatacagccaggggaagagaaactaagaccccttccatgcgcctaaacgaaagctgcatcagtccacagggaagtggtgcagctaatggcaggtctcaaactgtgggccttgactctttccaaaatgtacagaactccatatgaggttacactggacaaaaccggaaaaagggcagtgtagggagaggaggaagaattcacatcaatttctaataccacctgcaaaatgacactgaattctgtattttgtttgtttgaattatcaagaacgccatgtgactataggccctgaagaaagattgtggtaaatggcaccatagtgtattattacaatagaagccccaaatataaagaaagtgaaatatttttaaagtgcctacatccatggtaatagattgattcttcaatggttttctatctttatgtaatattttaaagaatatatctccaatactacccatagcatttttttttctgctgtagctttcttggcatttcataagcaactatgttccttgttgctttcatctccaaatagtttaagatatgaagcatattgggactgcaatgctggtcaaggaggggaaataaactgagaaagttaatatggggttcaaagatgcacatgattattctaactttatagctagaaaaactgagacctagatgggttaagaaactctagtcagtaatcagaggaactaattcaaatgtagatctgtctggccccaaatcctctgcttttaatttctatacattctgcttgttgctcatattttattttcccttgccagaactctaaaagaaagaccccagaacacctgtattagtctgctagggctgccatgtcaaaataacaaaactgggtgactttaatagaaaagtatttctcacagtctggaggctgaaagtccgagaccaagatgttggcaagcttgatttgtcctgagtctctttccgtggcttgcagatagtggcctcctcactgtaggtgcacatggactttctttcaggtgacttcatccttggtattttttcctcttcctctgaggatgccagtcctattggatgaggttcccactcttacgaccacagattttatatcagtgatatggactaagttcaggtcatttatatttttaaagtttagctatctacagagactctcagagaagactaaataggaaagggactctgtctgtctgaagtcagcaagggagaaggctgtggagaaactgatctagccattgggatgggctttagcttctatgggcagtttaagtctacaccataacatgtatctatctacaatgctattggtacttactgcttgtctttgtgtcagggtatttgtgacatagtatcttttccacactgagtggcttgtgggtagaacttctattcatgatgtctggtgatttcaataatagtgtcagtttaggtctactaaagtggatctgtatagagctgaaatatctcttcatagagaaaccgagaagtggaatacagagtttactagatagggaaaataattgataatatctttaattataaaagtgataaattcttacagaagataatttaaaacatgcagacaagtaatacctgagaatcctgtcatattgaaactcataatatttgatggaattccttctactactttattcatgttaacaaaattgagctataacctatgtatgatattgaatacatattcccttattatattatgactatatcctatcattaaacatttttgtaaaaatattttgaaatgttttgaataacattatattccatctcatatagcatataatggatatttattaatgcatttaaccatttgagcaatagtatctaatctatctctattttaaatatcttgacatagatattcttatacataaatctttatttgctaggttcctagaagaatagctaaatcaaaggtaatgaacatttgcagaatgtttggtatagtttgtcacattattccaggaaagttgtcagcagtgaattttatattcttaaatatttgattattttacaaaaaaaaaagttattttattttaatttgcattttaaagtactagttatagtgaatacttttctgaataattattaaccttttatattttcctttcattcatctaatcacattcttgatgagcaaaaatttaattggggtaaggaataattttgagacttctccacgagctatcctgttttttctggttacaatcacccacactgtttaaaatgttttaccctctacaatatcagaaacttccctactaacttggtttaatgtcccctcctaaatattcaaagtgtcaacaatttttttctcactcctacttcatttacttgtagtttccctttaggtttccatatagaatcgacattcttcccgtagggtttgccagtggatcttgctgccatggggggcacaagcaaagtaaatgcatttcaattcagaagccacttagcatccaggtggcttggatttttttttcttctttttcttaaatatgaagcattaaaagtcaaaggcattgctgcaccttgagttagtacaaaatttattttaaaatgcatacagttcaaattttttaccttgcataggccataagctagtagtatggtgggtcagttctgacactgaaaaatgaatccagttagagaacctcccgaaggctgttgatgtttgctataataaatagcacacactttaagtcaaactttttcattctgtattcaaaggtaatggatttttcgtaaccatagtaaccttggtgtattctggataaatacgtgaggtatatacattctagttttatttttgaatataaactaccacattatgtattactaataatatgaaaaataggatgtaggttagtataatgacagcttaaactagtatgcattttccttctgcaaaaaataaatatttatcaaaagtataggttcaattaatttttctcccagttttgtggtattctggtggtgccatttatctttttttccaagatctccattaatctcttatttctgtcccataacagatttttaagaattttgaggtaaaaacaattgtactttaaagcttatgattaaaaacataatcgaaagattgaaggacctatattgatatcactagcagagctattgtgggccacttaagatgtgtgtatacagtacattcccaaacaagtagacaaaagaaatccttcatgagactgttcaacataccaggattgtttcaaagttcaggctggacagcacctgatcgatgatgactatccagactgtagccacagattattcttattttaaacgagcaccctaccagaaactggccgtttttaagaagtttataagatgtttccaaaaagcctacaaactttttagaaacaaaaatagcaagatggtgctaatcaggacaagtctccaccaaacccggcaaggaggtttatgcgagttgtgcttcctagttagaaaatactacctgaattgcttttggttaagccaacctaagccattgctgtggataatgactagaactccaaaagaggaaaggttaatagggacattatagaaaaataacaactatctcacaccaagccataacacgtgtgttttcaaatgtatcatctgataaatctacatagtcatcttatagttaaataagagtgactgatatctagaaccatagatagtgtcttcccactgctgttccatcaggacctggatttctatcactaagactgaggcagtaagatatagataatagcaatgtaatgagtgtgtgcatgcgtgtgtgtgtgtgtgtgtgtgtgtgtgtgtgtgtgtaattgagagacagaaaaataaagagagggtagaaaggcagatgtgggcagggggaaagagggaggaaaagtggatgaattctggtaaaatcatataggcaataattatttatgtctaaccaactaaaagtgctaaaactttttttttggtcttatttgccaaggtcaaagagaactatgtgtaaatagcaaaatagaaatgctcatcttaaactttccaaacacttaagtcttacgatgggaaatttattgacgaagaagctgtattgcttatggcacaataaaaacacatttaaaggttaggcacttctatccgagcgttataaggaaccttatcagcactctacaaatttgagctaaattatactcattcacaccaatggcttacagaagctcttttcttagcaaaatagaattttactttaacctagatattttctttattttgcatatttaaatatcacattgcagtacattgaaataactcctcttacataaaaatactattacctaaaggaatgctgttaacacgcctgtgttctgttacaagctctaatattaataaagcagagcatgtgaggatttccaggtaagatgacggtctcatccatgagtcaccatgccactctattacaaacgaggtcataccatgtttccctttgatgtctcagtcatatagtattaaattgtacaaagtctgagaaactttaaggacacgaaggaacaaaagtcaagctatgcaataagtagagccttcaaagccaaattactaagctactaactctgtgaccagagactccagaatagttgttcaaggttgttctatataccagatctttgggttaatgaacagtggatgctatactctcaagagtcttattcatcgagcaacaaagggtcaaatgaaatgaaataacttgtacagaatgtttgaatatcagttgtggttagctgtaaacaatacaacctaagtgtcgttcttccattaaggtgcttctataatgcacccgtatgtgaagaaataaaatatgtttaaatttacattttaagacccgtacccaaatattatatgatctgttaacctaattaaggaatattatgttcgtaaatgatagggaaagattctatgcttaaagggattttagaagaatcatgggaataatattcagttagaaaagcaatggagttaaatgctggaaagataacggaatatgtccttcagttgaaagtgttacaaatagaggtgtcctgttattttcagcattttgagagttgctatgattttttatgtacgttttaaagtgcttaaattgagttataaattaatacagaaaagtggacacatcttaagggtacagcttgatggatatttacaaaggaaacacatctatggaatctgtacccaaaacaagaaacagaacattgtcagcaccctgtaaagctcctcattttgtggcctcaaatcttgactcaggtgattgctttcctgagtgttgacaccataaactgattttgctaattttgtactcaatataaatagaataagaaagtggagggggggtcttcaaaaagcttatggaaaatgcatattatgaaaaatgtgaggatttcaattttttccaccaaaataaactcatactaacttgttataacattcctgaaccagatctagtttgaggtggtaagaaagttaagacatcagtctgaaacaagcccctaccagggcaacatgaattcagtaaaattgaagcaaggacaaatatcaaatttctggtgaagcttgcatagaagaatagtgaaatcattgatgttttacaaaaagtttttgaggacaatgccccaaagagatcggcagtttacaagtggataactcattttccttaaaggacaaggaacaagacagtattaaagatgaagcctgcagtggcagaccatccacatcaatttagaagggaaaatattcattttgtctgtttcctaattgaggaagacaaacaattaacaaccaacatcatacacatctcaattggttcactttgtacaattctgactgaaaaattaaagttgaggacattaaacttagcaagctaacataggaacggaaaaccaaataccacatgttctcacttataagtgagagctaaatgatgagactcatggacacatagaggggaactacacatactggggcttttcagaggtggagggtagcaggagggagaggattaggaaaaaaaaaaaactaatgggtactagacttaatacctgggtgatgaaataatctgtacaccaaacccccatgacacaaggttacctatgtaacaagcctgcccttgtacccctaaacttaaaataaaagttaaaaaaaagttgagtgaactttctacttagtgggtgccaaaactgttgcacccagatcagctacagacaagagcagagctttcaatggaaattttaaacaggtggaatcaatatcctgaaacattttatcaaataattgtaataggagttgaaatatggctttaccagtacaatcctgaaaacaaagaacaatcaaagcaatggctactaagaggtggaagtggttcactcaaagcaaaagtggaccagtcaagagcaaaggtcatggcaaaagttttttggggatgcttgaggcattttgcttgttggttttctggaggaccaaaaaacaataacatctgctaatgatgacagtgttttgagaatgttagccaaagctttagcattaaaatgcccaggacagcttcactagagtccttcttcaccatgatgatgcccctgctcattcctctcattgaacatgagaaattgtatgacagttttcacggaaaatcattaggatcttacagttctgatttggttccttctgacttcttttcgtttcctaatcttaaaaaaatctttaaggagcacccatttttcttcagttaataatgtaaaaaagactgcattgacatggttaaattcccagaacagtcagttattcagagatggactaagtggctggtatcatcacttacaaaaatgtcttgaccttgattgagcttatgttgagaaacaaaggttatatttttattttttaattccattttccatgaaatttttgtagttcccttatatgttctcttttgtcactgtctttttcttagagatataggagggagagtaaatcagtacaacaattttttgtgttcctgtacctacattcagaaccctctgatctacaggcaattgctaagatgttgttagttgttaaattcctgtcttccagaaagccattggaaaatttgcaaactgaaacatctacctctttctccaagttcagatctagaaaataattatagaaatgcttcatctgtgcaattagaatttagcacatgaagtcactgacccgtgtacactagcaacaaacaaaccatataaaccattctgagtttccaacaatgtaatgttgtgtgaccataaagtttatgatgctgtagaaaaatatttaatttggaaagataataacaacaaatattttacacatatttgagtctaattcgttaaaatatatgtgtatatacatagatacatatacatggatgtgtacatatacatatataggtatgtccccatatggacatataccaaaatactaatagtgattatctcttaataatgggagtctggtattgcttttttttcttttccttgagagtcgttcaatcttttaaattctctacagtttggatattagaagtcagattctttttgtaatgttattcccaattttaatatatgtgataaaattgatagaaaggaaagaaatttcgggaacctgactacacttaaccattaatacttatctctagttttccctagtcttcaccttatatttaatcaggttgatcgtcttactaatttccttctagccaataccatagatgacctctagcactatctaccaccatcaaaacgttatgtatatttgatgatctacctcaattcccacatcttcatttgactcatagactcttccatatcaaattcctacacatttgtcatttggacacattctatcttgcaatattgacttattttcaaaggagtaaatcttgattaaaaataagaatgtaagtgcattggttacagttattatgccattatttattttcaaaatttctgtaatatctcacataggaataaggacccaactggcatccaacaaactcactgaattgagtttaaatgaattaagttgaaaaaacactgagactcagtaaattaatattttagagaaaataacaataaataccaatgcataatttggatataattaacatgctaaacttggtaaacaattttattgaggtaggctttcctgtagcttaggatttttcatttaatcatccaatatatagcaaatatatacaaatatttgttgctcaattatgtgttttagcttgctaagactattgtaacaaagtaacacaaactagatggcttaaacaacagaaattgactgtctcacacttctagagacagggagtcccagatcaagatattggcaagactggtttcttctgaaggctatgaggaggaatctgtttcatccctctctccttgttttggttgtttgctggcgatatttggcatttcttgattgtatatgaatcatcccaatctctgccatcatcttcacataatgttttccctgtgtgcttatctgtgtacaaatttctcctttttataaggacactagtcatattggatttgggcccaccttgttgagctcatctgagctaattacaactgcagttctagaggctaggacttcaacatatgaattttggggagaacacaattcaacgtgtaactctagtgctgtgcatttgatgctgtgattaataacattctaaaactttcctgaaatacctaaaacatattagagaatttaaggtgtgtgttcacaatcagttttaagatggatatggcccatgacagtaatgaaaatatttagaaaaggtgataatcaattccatctggaatgctcccagccttactttttgcatcttcacaatcacatctcttacttccctggcttgctttctttgattctttataggagtgattagtttcctagtgctgcttaatacaatacccaaaatgggatgccttaacacaatagaaatgtattctcttgaagtttgagaggctagaagtttgaaatgaaggtatcagtaggcccattgtctctctgaaaactgtaggggagaatccttccttgcctatcccgccctccagtggtttctggcagtcagtggtattctgacagtcagtggtttctggcaggtgtctgtcagtcagtggtatcctggcagtcagtggcttgcagttgcgtcaccccaatctctgcttgtatcattacatagtgttttcccttcttctaaagttctctcctcctctaaggataacagtcatattcaatttagggctccccgtctttcagtatgacctcaacttaacttcatgacatctgcaaataccttattttcaaatgaggtgacattcacatgtacagggagttaaaacatggagataccttttgggaggacaaaattcaatccactacacctccattgactccacaactactttgccactcagttgaaactgttctcacctagattgtcaatgttctggtagtctccaattcagggacagagtggaggttgtataattcatgatgttttattgatgattcctccatctcagaacattcttctcttggtgtctgtgatacctcaccttctcaattttccctattactgttcaagctctggtgtgatctcttcctcattttcttccacgcacaaatgttggtttcccccaggattcctcttgaaacattccacacaatctccctttgaaaactcagtagtccttgtcttcagatatttttcctaagccatgaacatttttctcactgcatattgggcactcctgctacaagtgtttttactccaactccttaaaactgaatttattttatctgccacatcctaccaatgtgctcttttttctgagttttttatctttgggaaaagtaacactattcattctttttcccaaacaaaaacccagcattaatctttgattactcctccttcatccttcacatccaaacttttttgctgttcttgttttaagacagggtcttcctgtgtcacccaggctggatggagtgcagtggcgcattcacagctcactgcagcctcgacctcttgggctcaaatgatcctcttgcctcccgagtagctggggccacaggtgcatgccactacacctggctaatttttgtagagatgaggtttcaccatgttgcccaggctggtcttgaactcctgagctcaagagatctgcacatccagtcttaaaatccaaactgctgttgccctattacacttatcacctggctcctatctactttcttagccttatatcattcttttattctcatttatttctacaacactacattggttttctatttctgttggtttgttttgtgaaataccacatgccttttcctacatgcagacttttgaactttctgttcactctgactggaatttactttccccagttctttacatggctgaatcattgtcttccttgagttctcagatcttataaaaccttctctatatttgttagaataacctagatgttataagcatacacacatatacatacagagagatgatagtttttaatagtgaaaacacaataaaagtttatttcttgttcacttagcattgagtgcatacaaagtttggtccacagagtttcctttttctgcacagtcattcaggaatgcaggcagatgcagattcagattctgtcttatttaacacatgacttccaagggagctctggagttatttccattgctacagcagatgaggaagaagattgagagatcatcatggcagattgttatgggccaggcctgggagtgaaggtattaaagcaataccttgtactaactcaaagttctgtaaatcagaaatttgggtggatttaattgggttcgtaattagggctttacaaggccaaaatcaagagttggggcagtttgggctctcatctgaaggctctgggaaataattcacttctagactcattcaggttgctggctgaattcagtttcttgcagtggtaaggccaaggtccctgtttccatgttgcctgtcagtcatgagctgctatcagcttctaggggccacctcaggtcctttcacatggctccctccatctcaatgatggaggatatccagtccccctcatgcttcaaatctctctgacttttgcctccagctggagaaaacactctgctttaaattgctcgtagttagtttgcacccaccaggattcatttccttttctccatataaggtaagataatcataagtgtgatatctcatgaaattcacagattccacccacactcaaagggggaaaattgtatataggtgtgtgtcactgggagtcattcttagaattcttcctaccacaggttcagaagcagaatcactcaagcatggttcttaccctgtgaccttactaagccttggtttcctggtagaatggtaacaacagtacctactttagggatttagtataaaaattaaatgtgatagtgcatataaaaagattagcataggtcccataactcttctaaaaatggtaaataatcaacaacccatgctattagtcgcagaaataaggaaattattgttatatcatcataaatattcttaatgcaaaacatcctctgcatgcaaaaaaaaagcatgtctctaaacttcatgttcaatttaactcagaaaatatttgttgagcaggtactatgtacctcagaggttagaagttatttataaaactaagatactgtcattcttcctcaaatcattcccagttcaattgcttagacagaaatacataaaactaaatagaatgctgtccaacctgtggtaaattctgtaacatgtgtgacaacaaaagagaagggttcaacccagtgtggaagataaagtgtcacagaagaatgttcacaggctttagagtcgagtttaagaactgaggaacaggcaaacataaggaccatggttgcgtagtcactagacacagaactattaatgcgcatttcacaaaaattaaagagggaagagtttaatatgagtgtgcaccctgggtaagtaatcaatagtgagaagcaaggtgggattgagattatcaaaggtgctaagttatgttgagatatttgaactttgttctgaagcaagagagaaccattgaaggattttcagaaataccacaagacaatcagtgctttagaaaacacatagttggaacatatcattgcttcaacatagcgaagactgagtctgtgtagctgttttctccatttagcaggcataaggacaagtgggttagaacactaaatgcaagaagctaattggacttaacaatacagatggcaaaaggatgaggagaggagagaaacgcattatgtttatttgttaacagctctattgtattgtatttatatgcattagtcagtgtaaaataaaatctgcttattttaaatccttttaaatagtgtttaaatatttcctgatgacacaatctgctaaagtatttacccttggtgcagatttccattaaccttgctgtagatactaagcctacaaccatatatttatagggggctcaattatggggtaaagcctagtgacatcattataaaagcacatctggataagctttagggtctttgtctttctatctgatttaggaaatttagtaaactgtaggagaataccattattaacagcccctgaattctcagattatgaggatgtcctttctctcaaaataaaggaagagagggattaaaatctctaaagctgtaaatgatatagagaaatgcccagtacacagatatcagggatattaggggaatccagttgtgttggatatacaagaagaaaaaaaaggcagaaattaaattcaaagtattctttcctcatgtcttttgtcagtttttttttattgttttttagagagtctatataaatcctttggttccctaaaggacaaaattcctttgataattttacaaattcttttctaaatagtatctctgtattgtagattaaaaaaattaatacctaggaaaggtcaggtcacttctttcagtcaaggaatgactcattcatgaaactggaaagaaaacttctttttcactcaccccaatacttgatagctatcttaaattgaatatgtctttaacagtatatttgatattatcagtgtattttgatttatatatatatatcgtatatattatatatctgtgatatatatctatatatcatttatatatctgtgatatatatctatatatcatttatatatctgtgatatatatctatatatcatttatatatctgtgatatatatctatatatcatttatatatctgtgatatatatctatatatcatatatattatatgtctgtgatatatatctatatatcatatatattatatgtctgtgatatatatctatatatcatatatatatctgtgatgtatatctatatatcatatatattatatatctgtgatgtatatctatatatcatatatattatatatctgtgatatatatctatatatcttatatattatatatctgtgatacatatctatatatcatatatattatatatctgtgatgtatatctatatatcatatataatatatgtgtgatgtagatctatatatcatatatattatatatctgttatgtatatctatatatcatatatattatatatctgttatgtatatcatatataccatatattatatatctgtgatgtatatcatatatatcatatattatatatctgtgatatatcatatataccatatattatatatctgtgatatatatcatatatatcatatattatatatctatgatatatctatatctctctctatctatctatcacattttctttaaccattctatcagtgatgggcatttaggttgattccatgtctttgctatcatgaatagtgctgtgatgaacatttcttttgatttttattgtctgtgttaggacatcataacagggccctcctaataccattaacaacgcatcatgaccctggtaatggttttgtagctgaagtctagatagtttaagtgccctatcttattcatttgtacatattcaatatatataataactactattttctggacgttaagagaattgctgaaaatacagtggtaaactgcaatgaccctatatatcctggtttgtacactgttttatcttctgtttcagttaccttgcttaaatcttgtggctatatgacactaataaaagttaccaaatttgtaataaatagcatcacaaatatttcattgtgcttgagattgtttcaaaggttttgatttttctggctatacacacacatatgtaacataacataattaaaaatgtaatgaacatcactagactactagttaaacaagttatggctaataactaatatgtacacaaaatatgtggacacaatagaacaagcaaatctttatcaataggagaatatcttcaaagtgtatattgtaaagcacttgtgcagaaaagtatattctatattctgctaatgtttatttgtttggttatatgtatgtagactacatctggaggcatacatataaattcaataattgctaaattcctaggagaaaactgggtaatagtgacacaaaggtggagagagtcttaatttttatgtaaggtcttctgtacattttggctatcgtaccatgaatatatattaatgcattattcattcaaaattaagtacaatttaaaaataaaattactacaaaatggtaaattttaaatgttaaagaaaacttggaaaaatataaagaaaaattcaaattgtccacaattttatctaccagacacaatcactaattatattttggcttatgcatttaaagtctgtttttttattattaaagcacagatacaaacatataattgggaccagactgttttacaactttttaccactttataatatactaagcttattaccaaattgcttgctcagcattcttttatgtaacattttgtgtatgtgcattttaagttttttaaaattaataccacaaatgtgtttatgcattatttaaaatgatatattcttcttcctattttgtaaatgttttaatatatatgaaggatgctaaccatttgcatgcactctatatgacagttatttttttccgctttgtcttttgtatttttttactttgtttatggtggtttttaaattaagacatttttaaaacttgtagtcaattcaaatttagatatattttccagcatagtgtcttccttaaatagaaacacttagattttcttcacttcaagaatagataaatatttcctgagattttctttgataatttatactttcaaaaatattttcacatattccagcttctgtgaatatttttatttatttatttatttatttattcatttatttattgagacagggtctcactctgtcgcccaggctggtgtgtagtagaatgattttggctcactgcaaccccgcctcctgggttcaagccattctcctgccttagtctcctgagtagctgcgattacaggcatgcaccaccacacccagctaatttttgtacttttagtagagacagggtttcaccgtgttagcccggctggtctcgaactcctgacctcaagtattccgcccaccttggcttcccaaagtgctgagattacaggcatgagccactgcacccggccacttctgtgaatctttaaattacccaatgatgtgtataagggttcaaattttattcccattttctcagtgaagaaatagagattctgaaaactgatttgatatgcctgaaatcataaagttagttaatgtcatcgctaggactagaattttggtgcttacacaatgtgctgactcccaaatcgtaaatttctaccagatgtttaaagtaaaagaatgatgggaaatttcattaaactattaactatattcagtggtttcaaaatattaatacaacattgatatctttagtgcattatcaatgtattcttggagacaacatgtcaattaaattgtctcttattcaaatgttaacttcagtttttaaaatttaaagctagtctgctgattttcaataagagctgtctaatattgtgaactagtgaatttgaggagataaaagtggaaattataggtctgcagagtgtagcattgataaagagggggccatttcttccaagtcagtaaagaaaagtgatgaaacataaactggaatttttgtgattctactgttgcatgaccttataacacccctgttttaattaactacggacctgaaataataacgtatatttctaatccactcacaggaatggtaggtatattagttagctagggctgccatgacaaaatacaggctgagtggcttaaacaacaggaatgtattgtcttacagttctgggtgctagaagtccaaggcaaaggtttccataggttaggtttcctctgaggcctctctccttggcttacaaattgccgccttcttgcaatgttcttacgtggtcttttctttgtacacgcacaccctggtgtctttattcccatccaaattttctcttcttataagggcatctgtccgattgaattaaggctcatcataatggccttattttgacttaattacctctttaaagaccacatccccaaatatggttacattctgaagattagaatgtcaatttatgaattttggacggacaaaattcagcctatagcagagggtctgctttgcaatgattatgcactattactcaccaaggtagtaaaaattaagcaaacatttatatacacaagtttttgaggggataaagcctacagaatataagaacaaaatattttcaagaatgcctgtctgtggttctttcattaattcacttcttcattcatctttattgagtacgataatgaggcagggaaaatataaccatctgactatgaattgacctggtgcttgtagacatatgtggtttaacagttttccactttgtgtacccctctctcataacatgtagcatactctgctagaattattgattgattaacctcattgtctttctcactagatcatgagtactttgagggcaggaactttatctttcatctttcatcctgaagacatggatcagcatatgtgtatagtaggagaacaataaatagttttcagaatgaaggggagaattaattttttcatgaaaactagatgtcattatgtggagaatttatcagaatgccagactggtaaggatgttcagagacacagtagttgacctaagactaacctaaatctgtttgtatcacagaagtgtaccaatgcttgacatacattggataaaatgtttatttcctatttctctgtattgtttggccacatgactattgcaaagctcataagcacaaaatttgcacaaaacccctgagagatgccatccatggctacaaatacatgttttgattatattaaagtaaaaaaattgatcaattattttaaatattcaaggtagttaagtgaataaattctatgtaattacaaccacaaggttggtgcatattttagaaataaatgcttgttttactatgagaggaaaactgcgaatggcacacgacctaaacaagggcatcctgtttgcttggatgaaaattccatccccatgtttactataccttccactctcattcaaacctagaacaggagaaaaatagttcgagtttaaaaacaaatccagtagagtttaggaaagtttgtctcgtataccacacctttaaaaggctattttgcaatgacaatattcttgtattgccctctctatttttccctccctattgtatacatgagcccagcaacttctagaatatactagcacatatgaaatttttgaatatctatttcatgtagggagattagaaagtcactttctgccacttgtgtagctctattatgcaaaaatcaagaggatgcagatcataaatcccattagggtggaactctggatgtggaaaagactatatagataattttaagagatttcccctcagctgaatcattgctataaagttaagcatggtttttaaaatataaatcaaataaatggtttctataaaggcacatacctttactgtaaactgaactccaacaaacttttgagtggacatttctcaaatacagcatctattgaaaacttcctctgaaaaaacatttcataaaaattgaagcttgccttacatattttcatactatgtggttttaatgaccgttgtattccactctatcaccataaataaatatgtgactttaaaagatatgttgtaaataaaattagctcgaaaatactaacactaaccaaacattaatcacagaatttaaggagactatcagagactaattcagaaaataaaaatattgtaaaattactaccatgaaagctctaagaaaagttcatgataatttcagtgatgctaaggctacagaccaaatataaacttagaaacaaaagtatttagtctaagacaaattaaatgtgtatatattaatttattttctctgtttgatgggcatagaagcccatcaatactctgaatttatattttattaatactctcacaatttactttcatatgtgacttactatgtaatataaaaaacaaaagagcttgaaaaactgagatcagagggcaacaataaaatattaatgctaatattatcttgaatttttatctatacatatttaaatgttgttatcctcactgaaatttgttactaatcagtgaaactttagtatttacctaaattagttcttcttataagtagctcaatctccataataggagatagactataatttgtactttagcataaatattcttctaaaatcattcaccgttttatattgtaattgactgaaacaatataaagtggcttaaaatcattggtatattataaaacctatgtcagataaaacatggcatctgtgaagtttgggaattataacccagaacagtgtataattcaaaacagatacctgaaattatcttgtacacatctcgctatctgctatatctcatcacataaaatgcatagtagatgcacaaagtagctgtccaacaaatacttatggaattaataaatgaaggaatgacaaaaatgcttttcctcaatgtgctaagtcaaatacatgtttccttttataaaaatttaactatatgttttagatttagttgaaaaaatctatactggaatttacataattacataatacatattttaaagtattattcccagtatttatgaacattcattaatgagaatggcttctacattaaaagatcagttagcctctgctatttttgataatgatttaaacttgttaattcttacctgtataatgcattctcctttacaaaatgctggtatggccacttgttttatgttatcctcacaacaattgtaggtatagatgtgataaataatatactcttcctattctgtttttctttttaacaaatgagaaaactgaggcctaaagctccagtgattcactcatgtttacacaaataactctaaactggcgctcagctcttgctaattctttgtctcctcttttgttttgtttttgtttcattttgtttccctaaaccataatgccatccaatattatttaaagtttgcctgcctgcttttgcaatggttcttagctttccacaatagcaagtgcatcaaagaagaaaaaggaaatgattatatggttattaatcaaactcagatatggctagtaccacctttataagtgaaacttatataacaatctcagtttatgtcagtctcttatcccagtgtttaaagttttaaggactgagctgggaatgtgaggaggcttttgcttttcattttgtactctactagttttaatttttcactatgtgcatacatctgcaccccaacctttaaagaattagtttcctgaaaaaaaaggaaaatgcaattcatcgtacaaataaaagcataatcccttttattaatttttagctaacaaacacataataccatcctattccaggtactgtttttaaatgacttgtatctaaatgtaatgttaacgcatactttcgatgtgcataaatatagccaagcagtcctaaattcagataaattatcttccatctactgtatataattatatagtatttcctaatttttataaaatatggtttgtgtgtatgtatactgttactcaaatgaggttttgttgtttttctctcctcaaggtcaaaaacaatatctcactctatcttttgtgtcttttgttttttgatttttttttttttttttttttttgtctgctttgaacagtttttaagaggaaaagaagaaaaggtgtttgggggttacataaaaaaagggagaaagagacccaaatctcctgtctcttttatcacctacaaactgtattgattttcactttcctttcctaaatccatgctttaaagacattgtccatctaagaaacatagagtcccaaagcacaagttttgatgtagtgagcacccattgattgtaccttgaagtggatgtaggtaaacagatgacagatagatcaggtagatatatagatatagatatagatagatttatcttgaattttcctagatcccattaatctgaatgtacaaataagtctcattagttctaatatttgtatttcactgcctcattgccctcacctgctgtagatgatctctgcctccagcaaactaatcctcatgcatttctggggagtccatatgggttttctcacttgcacttaggatcaagctggacaccaattggctaagtgccacggttactccactgggcatctccatgtcccttctctggataaacaccatcatctatgggcataaggagcactgctattcttccattgctgctccaccaggtacctgagctctcccactgctgtgccaggtggaatagttttccaccaggggccaccttagatattcctcgtcaggtgagtaccaggactgctttgctaggtagagctgtcccagtcgattctaatatgcccctctgctgttatatctgtatcactgttctgtattctgctagtaccaaagctgaatgagactatgttaaaagtagtggtggaaaaatgtctttcttccttgcctccctctttcttaagtgagtcctaaaagaatactgagtagattttggtatcttaaaggtttaacaaaacagatcttctttgttttactctaaatacaaatctgagtaaactagccaaggctctcagaatgatctctctcttctgagaaccagggcaccatacctggctccgatttctctcatggtgaattcttcaaaatgttttccagtgcatgggctttcgctgggttatctcccacgttgttcacaatgttcagagatatctgagttaacagcacacccagaggtgttccctctttccatgactgtcccccacaaccccacgccaagaatgccactccccagttctaatggcagtatgctgctggtagcctggccacctgtctcagtccatttagtgttcctataaaggaatcacccaagactgggtaatttataaagaaaagaggtttaattggctcacggttctggaggctgtacaggaagcatggcagcatctgattctgaggaggcctcagggagcttttactcatggtggaaggtgaaggggagcagatatatcatgatgagagaagaagcaagagagagagagagaggaggaagtgtcaggctctttttcaacagccagttcttgtgggagctaagagtgagaactcattcactcccatgagaatgatgccaagccactcatgagggatctgaccccaagatccaaacacctcctaaaaggctcagcctcaatgttggggatcaaattgcaacatgagatttggcagggccaaacaaaccctatccaaaccatagcaccacccaatttgccagatatacccaggcagatctaaatatatcttacactcacaatcaggtcctccttttatgagataccaaagatgttccattagggttctcagacaaacagaatggagaaagagagatttattgtaaggaattggctcacatgactgtgggagctgacaaatctaaaatctgaagtctgcagggcatgttagcaggctagatatccagggaagagttagtgttgtagtcttgggaccaaaatcttcagggcacgtattagtctgttctcacgctgctaatagagacatactcaagactgggtaatttataaaaaaggaggtttaattgactcactgttccacatggctgtggaggcctcataatcatggcagaagagcaagagatgtcttacatggcagcagacaatagagaatgagaaccaagcgaaaggggaaacctcttataaaatggtcagatcttatgagacttattcactaccacgagaacagtatgggggaaactgcctccatgattcaatcatctcccaccgggtccctcccacaacacgtgggaattatgggagctacaattcaagatgagatctgggcagggacacagccaaaccacatcagggcagatgagaggtttttgttcctcatgacacaaaatgtggtgtcttttccaacaccacttcttcaattctctgacactcactaggcatgctatagttcagctcagttctgacagtaactacctggagttagagtaagactccatagatttaagagcccagtcccacaagactaccttcccttcagaggccaggcacaagtattgagtccccactttagccacaattctctccagctgagctacacagtcttgggttcccacaaccccctcttcagggttgataatttgctagaatgactcacagaactcaagaaaatgctctacttactattgcagtttattttaaaggatgcatataaacagccagatgacaaacctcctcaaattctgtttaggggcttttaggaggtttcatgacataggcatgattgatcaaatcattagccattgatgattgactcaatttccagccactccccttctcccaagcggttgctgattgagtagtgaagctgaaagttccaagcttctaatcaaggtttggtctttctggggaacagcccttattttgaagtagtctaggggccgtctgacagtcacttaattagaacaaaagatgctactatcatctttatcactcagaaaattccaaggattttaagagttctgtgccagaaacctggtacaaagaccaaatatcttcttatatcactgcaggccagcagactggaaactcccatagaatttttatcatgcagtcttgaggcagaattctttcatctttgggaaatttcaatctttgctctaaaggctttcaactgatcggatgtggccaacccatactatgtagggtaatttacttaaagtcaactatctataaataaatgttaatcacatctaaataataactttatagcaacatttagattggtgtttgatcaaacaagtggataccatagcctggccaagttgtcacacaaaagtaaccatcacagatgtattattttatttaaaatcatcagtattatatgaattaattcagaaataaaaaaggtgttgtcatagtgtgaacacttataagtgtctttcccacagaaatgtcaacagactgtgatttgaaaattgctgttttaaaagagaaaagctcatcattctacagaaatgattcaaagatagacaatccattaaatatcttataatgggccaaatactactagttgttaatttacacttgcaacatcaaacactttaccagctttttaacatgcaactgttgcatatgatgcattgtgttttttgcaagtaggtatacagcataattctaataggatatttatttacaacctaaccttacaatttaaagtctgctactccattgtgctcatcctacccgctgtcttcttatattcaaagctattaaggagtacttgctcagcatatcactccaaattaaactgcaagacattttatgatgaattaaatgggtgacgctctcccagcctttgtaactactagagcaagtatccaagaagcagacaattttatcacaaaattctgattgccaagttgtttttattaaatagacatacagtagagaatttaatcttagaaagcatctaacataaacacagatttctcgttttatagatgaataaactaagatccaatgagggcaactatttttttccaagttcatgcaggcagctaacaccagaacaaagactaaacaaagctcttctaacttctccccccatttttatcatccattgcattcattactacaaaattactacaaaattattagcctggtctttaatggtggccccaaagaatggtttttagtattacttccttcacttctttcgtatgtcctgtgctccagctaaactgaactatgttgaactaagctaaacatttctccttaagcttgtactgcattttgctacagtctttttgccaactcttcccatccagaatgtcttcactctctatctccactgctttaaaacctaagcaattttcaatttaagttctatctcctttttgaagtattgtatattcttctagccagataaaattctaggaaaatattgtcatacttgactgcataaagatttaaattgtctatatagcaaaataaaaccattattgaaatgataaaacaagtgacaaactagaacaaaatactttatagcatacttatttaataaatatctattgatagcttgctaagtaataggcactatactaggtgctatatccaagtaatgttgacttattagctttcaattagaaaaagagaaacactattagatatgggtcaattagataaacaggcacatccaaaaagaaaaaaatatgtaaatatagtcacagagataataataataataataaatgagatgctacttaacatttttcaaatgtgtaaatattttttaaaattagatttttccatattgattagaagatggagaaaagagctctttcacataatgctgctgtgaatgaaaattggcaatttatatcataatgtgccacagttttgttctgtatggtctcaatcccccctgtaaatgtgtgctctacttttctctaccttgtcctgagctttagcctctggattctctttgggttctgccaacgtaagacacaataaagagaacaacagacaggagggaatgaggccgaagtgtttattcctcaggctctgtgcttgcaagggtccccaggctctgtgcttgcaagggttcagatgggcagtagctgttcctccattgaggggaggcccttcctacagtacagctgtctttccagctggatgtggtcctcagcctaaggcagcaatggcttggtctgtgtttagccactagctgcgttcttattcttgaatgtgccccttaagcctggcccaaatcctgtaaatagtccctgacatatttctcttcaataattccatttcagtgtgccatcttctcccttgtcaggaggaccccaaatgatccctctttgactgggaaattctacttctaagagtttatgcttaaggtgtaattaagaatgtacccaataatacagtaatccatattaaatgttataatagtagtaaaaatgacactagtgaagcacaaaagagaaattaatccaaactgaaagagtttgagaaggtttcttatagggtgtggcatttgatttgtgtcttaagggtagcatgagactatgccaaaaaagaaatgtgtatgtcttgccacccaaaagagatatcttggccattgaggatagagattcattactttcttatgctatataaggcgtagtatagggctaggttgaaatagtattaaaataatatttaaggattgattataggttttcattgagaaccattctcaggtgatactttactaagctgacaatagacttagcactgcctggcaaacagcaagtagcagtcagtgatatagccatgattattactgaattaacagcatcttaatcttcactacgatatttgaaagggaacactgattcataaacctactcttttcctgccacaggtagtcaggaacttattattcttattatgtctcattattaacttctgttgcctaacaagatattatatattgtatgtcacatgaatattttcttacaaagtattaattgattcctaatcttgttaaagaatatgatagtagcaaatatccaactaattctgagagaaaaacctccagttttgcaagaaagatttagccaagttatgcaactaagtttgttcaaataataactctataaagttatctcgattatctcctctttagtttatgaatcgaaagcattgatgaagatcaaaagctaactgatgcctccctaattctatatctatccttgtgcagaggcaaagtaggggagtcagtaggatgtttgtgtgtgtgcgtgtgtgtttttgtatgtgtgtgtagatggagacagagaaccatagcaagatagagagagaacacgagaggagactgagagagaaggaaagagggaggaagggatggatggatgaaacgaggggctttctctcattttatatcataaaagtaaccaagaaaaaaatcctgggttcaatattttataattattacaaatggggtattagagatgttcaggaagccagagtagaaggcagctagctaagaatgctgtcagcctaaggagtttttcatggacgcctttttattctaaccagccacagaagaaaagagggaaatgaagaagcatcatccttcactatcacaactgacaataagggttctcccttacctcccacccccgcccccactacacacacacacacacacaaagtagtgactgaaaaccctcagcaggctgggctcccctaccacatgccacctgctgcaaatgtgttggaggcaccaggtcctcctttcttttttgccagttttcttattgcagaaaggttttactattcaacaattaggagtgtccaaggtgttaggggtcataagatacatccttgttctcaaagcgcttataacactgtaactactgatgactggtataaggatgcttacaagagaaatttattaaaagggcaactcagtagagtacaaactacgcatatgttgaagagagtcaggagatgtttcatggataatgcaaacattgaacagggttttcatgaaagggagggatgtggatttctctgataaggtggaaaacataagcacaaatggaagaatttgttgagtttagtatgtggtttgtgttcagttttaaatataagtccttatcatagcaaagcgatttcttttctttttgtttttgttttttccttttttaaattattttactttaagttctagggtacatgtgcaaaacgtgcaggtttgttacatatgtatacatgtgccatgttggtgtgatgcacttgttaactcgtcatttacattaggtatatctcctaatgctatccctcccctccccgcccaccccccagcaggccctggtgtgtgatgttccccaccctgtgtccatgtgctctcattgttcagttcccacctatgagtgagaacatgcggtgtttggttttctgtccttgcaatagtttgcccagaatgatggtttccagcttcatccatgtccctgcaaaggacatgaactcatccttttttatggctacatagtattccatggtgtatatgtaccaaattttcttaatccagtctttcattgatggacgtttgggttggttccaagtctttgctattgtgaatagtgcggcaataaacatacgtatgcatgtgtctttatagcagcatgatttataatcctttgggtatatgcccagtaatgggatagctaggtcaagtggtatttctagttctagatccagacacatgaaaaaatgctcatcatcactggccatcagagaaatgcaaatcaaaaccacaatgagataccatctcacaccagttagcatggcgatcattaaaaagtcagaaaacagaaggtgctggagaggatgtggagaaataggaatgcttttacactgttggtgggactgtaaactagttcaaccattgtggaagacagtgtggcgattcctcaaagtgatttcaactctacagatcagtttgaaagcacaggactggatctcagtgatggttaattgctcatctggccaaagaaaagcatgttgcaaggttaaggctcctatgaggaaaaggagagcaaggatgttcaggctgaataaagcccctgtttttattaattataaggtcagaatctggttctcctggaatcaaaatgctgagcaagcaattgtggagcaagggctacacaatggcagagatgaatgcaacctgatattccacatgcattctggcgcagctcattgcttttcaggcatctacgagaaacatatcaccccttaggtttgctgccgaagatgtgttctcactgaaccataacctagcagaggttctcaggttggaataccaaatagcaagatgatgtggtcagtgctacctatattgctctaaaatttttaaacatctaattgatgatttgtgggaaggttgcacagagagaagaaaggaaaaccaggaaaaagctgtgtttttaatttatgaaatattaagaagttttcggaagaagacccagacaatatgtattagatcataaagaagcaaaaaagtgctatgtaattttctgatggtagaaacaaataagaagatataaattcctcagtttacaccatgagtttaaagaaaatcatcacctacttactggttcattttgtaaattgagatcaatgaaattctctgaacaacagcatgaaatcaatcgtaaaatagcacataattcatggccagtattgtaaattatagtttgcttgacagtaatcggtaaggtttccatgcactgggatgcatttccttgtaacacgtctaaggataatgcctgtggatccatttctaatgcatattagagtgatctgtttttccctgtccacaactccctgtgtttgatcttatgcaaatgatgcaatcaagcaaatggaaaacaagatgttgttgctcaggggctcttacaaacagtggccttatgttttcagggtttccccaccctccatttacccaactcagatttgtgtacatacctgcaattgtttgaatccgttgatccatttgtgttgcccttgaagtgcctaatcacatctatagagacatattaccaaatcagttgcagttaagctaggaggagagttgtcattactttcctctttgctttaaatttcaaattggtggctttgtttatggcttcactctcaaagaatttatcagcctcacttccctgtaaccaatctttttttcatttctttttgttaactgtttttaaaaactctctcattccattcatacattttacacatgactactccttccccccacgcccaacctgatgcctcctcctcttctccatttttttccctttccctcatcatttcctcctgttttaccaagaatttcccaatcagatcaccgtgcaactttctctgccacatgtcaaattaggttctcttctctctctctctctcttttttcatgctttattattcaaagaacactagtaacatttcatcttcttatggaaatacattgagaataatccactttgggatggacagtacaggcataaaaacaacttggaactcaaaaaagctatttaatcacaatggttttctttgtattatgtttacagttttcagatttttaaaaccaaaagaaaatacccaatttctattgtagtgactttcatgtgagtccgtgtgaagagaccaccaaacaggctttgtgtgagcaataaagctatttatttcacctgggtgcaggtgggctgagtccgaaaagagagtcagcgaagggagataggggtggggctgttttataggatttgggtaggtaaaggaaaattacagtcaaaggggggttgttctctggaggccagagtgggggtcacaaggtactcagtgggggagcttttgagccaggatgagccaggagaaggaatttcacaagacaatgtcatcagttaaggcaggaacaggccattttcacttctttcgtggtggaatgtcagcagttaaggcaggaaccggccatctggatgtgtacgtgcaggtcacaggggatatgatggcttagcttgggctcagaggcctgacattcctgtcttcttatattaataagaaaaataaaatgaaatagtggtaaagtgttgggacagcgaaaattttgggggatggtatggagagataatgggcgatgtttctcagggctgcttcgagcgggattaggggcggcgtgggaacctagagtgggagagattaagctgaagggaggtcttgtggtaaggggtgatattgtggggttgttagaagaaacatttgtcatttagaattattggtgatggcctggatacagttttgtatgaattaaaaactaaatggaataagagaaggagaaaaacaggtataaaaggtctaagtattgggacgactcaggacatctgattagagagtgcctaaggagattcagcatagtcctgccagcaaagattatttatttacttcaagagttaagagtggcagtttggggatagcatgaggagatgtcagctgtgatggcttggagaaacagtgtaaactggcagtgtaaacaagagcaggacatgtatgagtagttgagaacggtgaataggagtatgactagacagaagatagtagggatgacaagtttttttggggcacagtctaagttggtctggtgtctggaatgagactggggcctaataaaaaggagcgtctatacaggagctcaaatgggctgtactttgtagcattccgaggacaggcctgacttctgagaagggaaagtggtaaaagtattgtccagtcctttttaagttggcggctgagcttggtgaggtgtgtttttaaaagacctttagtccgttctacttttcctgaagacggaggaccgtaagggatataaaggtttcactgaatactaagagcctgaaaaactgcttggctgatttggctaataaaggctggtctgttatcagactgtatagaggtgagaaggctaaactgaggaattatgtctgacagaagggaagaaatgactgcggtggccttctcagaccctgtaggaaaggcctgtacttatccagtgaaagtgtctacctagactaagaggtattttagttatctgactaggggcatgttgagtaaagctaatttgccagtcctgggtgggggcaaatccttgagcttgatgtgtagggaagggcctgaataatccctgaggagtagtagaatagcagatggaacactgagaagttatttccttgaggatagatttccatgatgtaaagaaaatgagaggttctaagaggtgggctagtggcttgtactgtagcatagcctgcctttgctggtgtgtgatgattaggcctggtggaactgccatcaataaatcaagcgtgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaatcaagcgtgatcaggctgaggaacaggaaagaaggaaatatggggaaatggggtgaatgtcaggtggatcagagagatacagtcttgggtgtcaggtgtggtatcaggaataatgtgggaggctggattgaagtccgggccaggaacaatggtaattgtgggacttaacaaagagtgagtacagctgaaggagccgtggagcagaaagtatatgcgtcaggtatgaggaagaaaatagattttggaaattatgagaaatgtagagagtaagttgagcatagtttgtgattttgagggcctctaaagtattagggctgcagcagccgctgcacggagacatgatggctaggctaaaacagtaaggtcaagttgtttggacagaaaggctacagggtgtggtcctggctcttgtgtaagaattctgaccgcactaaccatgcctatgaaggaaaggaattgttgttttgtaagggattgaggtttgggagattaatcagacacgatcagcagggagagcacatgtgtttttatgagaattatgctgagataggtaacagatgaggatgaaatttgggcttgattgaagtaatgggggctatctgtgaagctttgaagtacagcccaggtaatttgctgagcctaatgggtgtcagggtcagtccaagtgaaagcaaagagaggctgggatgacgggtgcaaaggaatagtaaagaaagcatatttgagatccagaacagaataatggattgtggagggaggtattgaggataggagagtatacgggtttggcaccatggggtggataggcaaaacaatttggttgataaggcatagatcctgaactaacttgtaaggcttgtctggttttaggacaggtaaaatgggggaattgtaaggagagtttataggctttaaaaggccatgctgtagcaggcgggtgataacaggctttaatcctttcaaagcatgctgtgaggtgggatattggcattgagaggggtaagggtgattaggttttaatgagatgttaaggggcgcatgatccgtcgccaaggagggagtagaggtatcttatacttgtgggttaaggtcgggggatacaagaggaggacgcaaaggaggctttggattgggaagaggggcagcaatgagatgtagctgtagtccaggaatagtcagggaagcagataatttagttaaagtgtctcagcctaataagggaactgggcaggtggggataactaaaaaggagtgcttaaaagagtattgtctatgttggcaccagagttggagagttttaagaggtttagaagcctggccgtcaatacctgcaacagttatggaggcaagggaaacaggcccttgaaaagaaggtgatgtggagtgagtagcctccgtattgattaagaaggggatggacttaccctccactgtgagagttacctaaagctcggcatccgtgatggtctagggggcttccaaggcgatcgggcagtgtcagtcttcagccactaagccgagaaggggtcagtcagagaaccttgggccagagttccaggggctctgggagtggctgccaggtgagctgaacagtccgatttccagtggggtccggcacagatgggacgtggcttaggaggaatcctgggctgcaggaattccctggcctggtggccagatttctggcacttgtagcaagctcctggaggaggaggttctggaggaaggcctggccgctgcagttcaggcatttggaagttcttgtgtgctggagatgtggctggggttcgtctcacagtggaggcaaggaattgcaacttttttctattattgtacaccttgaaggcgaggttaattaaatcctgttgtggggtttgagggccagaatttaatttttggagttttatttaatgtcgggagcagattgggtaataaaatgtatattgagtataagacagccttttgactttttagggtctagggctgtaaagcttctcagggttgatgccgagcgaccatgaactgggctggatttttatatttgatgaaaaacagcctaaacgctatctgatttgggataaagaaaaaggagcattaaccttgactatgcctttagctctagccacctttttaagagtaaattgctggtcaggttggggagggctagtcatggaacgaaactgtaagccggactgggtgtaaggaggggaggtgataaaaggattatagggtggaggagcggaggctgaggaagaattgggacctagcttggcctggcgaggagcagtctggggaggaggggagaggtcagatgggtctgtagaaaaggaaggttagaaagactcagccacgcttggacgcttggggttgagactgaggggacaggtgggagggaaagaaggaagatttgggacgagttgcactgggcacagagactaggaagggaccgatgtgtaaaagaatgcctagacgtcaggcacctcagaccgtttgcctattttatgacaagaattatttagatcttgcaggatgaaaaaattgaaagtgctgttttctggctatttggaactactgttgagtttgtattgtggtcaagcggtattgcagaagaaaataagacacttagattttaggtcaagtgagagttgaagaggttttaagttcttaaaaacacaggctaagggagaagaaggaatggagggtggaaggttgcccatagtgaaggaagcaagcccagagaaaagagagagtagagacacggagggaaggggttcaggggttcttaccctccagaaaagtgggaaagaggttggggcatggaaataagggattggggcacagagatataagaggtcagggtgtggaaataagggattggggtgcagagataagaggtcggggcacagaaataaggtattggggcacagagatacgaggttgggatatttgcccctcccccagaaaagtgggacttgctgctaagggtgaaggagaagaggttgggggtttcttgccccccagaaaggcagagaaggggtgaataatcagagaggcgtccctgcaatgattaaacaccaagggaaggctccttcccagtccgtgactggcgccagagttttgggtccacggatgaaacatgtctcctttgtctttaccagaaaatgaaaggaattgaaattaagagaagggagagattgaagagtggaaaggagaaagtggttgagggatagtgagaaaggttggagaagagagtaagaagaggttgcttacccaatttaaaattggtgagatgtcccttgggctggtgggtctgaggacctgaggtcgtaggtggatctttttcacagagcaaagaacaggaggacaggggattgatctcccaagggaggtcccccgatccgagtcacggcaccaaatttcatgtgcgtccatgtgaagagaccaccaaacaggctttgtgtgagcaacatggctgtttatttcacctgggtgcaagtgggctgagtccgaaaagagagtcagcgaagggagataggggtggggccgttttataggatttgggtaggtaaaggaaaattacagtcaaaggggggttgttctctggaggccagagtgggggtcacaaggtactcagtgggggagcttttgagccaggatgagccaggagaaggaatttcacaagacaatgtcatcagttaaggcaggaacaggccattttcacttctttcatggtggaatgtcagcagttaaggcaggaaccggccatctggatgtgtacgtgcaggtcacaggggatatgatggcttagcttgggctcagaggcctgacagtgacgacatagcagtcagatttcccaaaccagaaatctgacctaacaaactacttttttggtgtgaattagcttatcttaaaaacttagaaaacatttcaattgtacctaggttctgaaaatcttgtctgtgtggttatgataagcataggtgaggtgctggttgagtatgtggcattcataaatttcagtcttcaagacatatatgtatgtctctatctctgtgtacagttatgattttatttctataattcagtttaatatctgactttactcccatgcaacttagtagtaagtaaatcacagtcactttgggggtccccccacctctactaattatgtaaaagcttctggggtcttacctagttccttagcatctggagtgtggccacccaggatgctttctttctctgtgcaaagggataactattgagacaacccttccacattcagtgggtatcctcagtgcttctacatcacacttgggcaactgaaatctttacaaggttttctgtggccctgcctgaatacagacaccaaagtctttctttttgctctggtcttgcccccgacctgggactctaccttgaaaacaggggtcagggcccctccttcagagagcttgcacatttctacttccttttatccttattccatcaggcagggaattctgaattagggaagtggaagactccatacttcctatttctcccaacattatatctgagggaacagagtcttccttctctgttccctcagtcactctgtccagaagatttttttgtttttttttctgcctcctgaccagtcacattctgttttacagagaaatctattttatagttaaattctgattttataatttaattgagtgtactagttcgttttcatgctgctgataaagacatacccgagactgtgtaatttgtaaagaaaaagaggtttaatggacttacagttgcatgtggctggggaggcctcacaatcatggcagaaggcaaaaggcacatcttacatggtagcacacaagacagaaatgagagccaagggaaaggggaaaccccttatggaaccattagatctcatgagacgtattcactaccatgagaacagaagggggaaactgcccccatgattcaattatctcccaccgggtccctcccacaacatgtgggaattatgggaactacaattcaagatgagatttaggtggggacatagccaaaccatatcactgagaagcatttagataaaaattaaatgcagaaaacatatagggtcggtagcagggaaggacggaagaaataaaataggttagtatgacaatcagattgatctcagtacccattgaacaaatcctgagcattgtaggagtttagaagaggaagctctaagggcttcaatgtaaacccttacttggttcctcaagagaattgtccaaactatgaaaggagaagaaggaaaaacaaatcaatataatgaagagagtcacaaaggaacaacataattatggctgaaaagttccaaaagcccagttcaaactggaaaacctgaaattatactagactctttcagtgtgttcagtgacatctctcggaaacatcttagagatatgagaagtattagagacataagatgataagatttatccagaagtgggaactgggatagccatatagaagaggactggggatgtgaagaaccctatgtgacccagggagtatggctttgtaatggatgatcaaatttcattgatgagggaaatgaaactattgaaaatatctgggaataagaaggtaccaagagactggacattgtgtagcggcataggagtgattgcattgatgtgacaagtggaagaggtgggaagtaaccagtttgtggtcagagagtgcaggatttagatttagaatcttggaaatcattctgaagattatgaagtagtaggtgtaactatgctgaatgttgaataaatgaagtagaggtgaagggcattgcatttgaggaagttaaagtaaagccagattcagagatgagtcattattgaggatgttagagttgccaaaaagggattatgattgaaaagaaaactgagccaatgctgaagtcatagaggagagaagcagtgtgaccggagatgtgatgggggcatgcgttaactaggttggggcatatcttcttttaaataatggattgatattaactatggctattttttctccatctatgatataaatatatatcacaaaaaatttgaaaaatatatgtaacaaaaattaaatcctctatatgcactcactcagaaaaacattgttaacatttggtttaccactatctcctgttttgtttttattttttttattgtttctttcttttacaatgaagcactggtactttaaaattatgttttggcattcagacaggtacagctttgcctttttctcgtatttaatggtaaatctcctttgtcttacaactatagacccctacattggcccaacaattatattcattatattcttggagactttaaaacatgtttagacattactatatttctgagaaaaaaaaatggcagcctgggtagagggcatggggatatccttctggtcttgctcattcatttacaacaagtaaaattatgcgagttagtcatcacaccattcctggagatatcctgctgaacatgataaaaaatatttatctgaactcaagaagtttacattctcctgggaaggatataatatcaagatataaatgaaaaggcaatattgaacttgttttagtaattatgatatggaactaaacaaggtgatataacaagaacctggggatgatggtggccatattgttcaattatcaagaaagaccactcatagaaggatgaagctgaagcataagaaagagcaatccaagtacaaagagagagaaaatagatttcagtcagaaggagcagcacctgcaaaggcccagaagtgtgaacttgttgtgttagaagaacagaataatgtctagtctagtgtatgaaaaaaatagggagaatgttacatcaaataggatctcattgaccattattagatttcgttctaagagcagaagaagggtactacagggtgttactctgaagaatcaaaagatcactcatggtaaatggtcttgttttcttcattgggaaaattgaagtagttagaggataatgcccatagactctgctaccatctacccacctaccagtattggcacccacatagtctgcatcccctcccattactatagattgtctctgttccaagttcaactctttcacttttgaactagattctcctctttcacatattcaaggacaaaactccagcaatttttttctctttcatccacttcatagttttcccttcactagtgggtcatcccatcacatacaacaaatttttctctcatttaaattactttaaaaatcttctcttgattctacttaccttttatctattgctacatttatctgttctcctttaccacaaaactttttgaaaatgttcttttattcactgtttctaattcctcttctatttccttataagcccacttaagtcaggctttagtgctgacaagttcactgaaacttcaattgtgcaattactgatgactgccatattgttatacccgatggccgatttttaattctcatcttatttcacctttaactcttaaaaattacttcctttgactttcaagacaccataatctcaatgttttcctcataccttactggtcactctctgtctccttggttgatttctcctttactcattggcctcatatgttggtatcccagggttttctcttttatatctattctcactccgtttgcactcctagccatctatatgatgatgacttaccaaattatatatctcaagccatgaactcttcctgtaattccaaacttctgttcaaatatcctgacaatctcctcttggttatctaactaacatagcaaatgtctaattgacattcattatatgaattcttatcttcccctccatgccttcctcaaccaataaaatggttactttatccttccctttgctcaggtcaaaagccttggagtcaactctgggtcttctctttcatactctacctacaatgcactgggaaatcctgttagctttgcctttaaaacatattcagaatttaaccatttcttacttgattattactggcccccacttacttgatattacaaatagcctcttcagtgagatgtattcttatgctcttgctcactaccatctatacgtctggcagccaggatgatactcatgaagtccatgtttgattgcatgacagctctgttcaaaatccttagtgtcttcctaagtagaacctcttagattaaaaaccaaaattcttacaaagacctacaaggcctgcatgaactgacccctcattaaatctctaatatcatctctaacttacttcttcctaatttgttctgctccagccacctcagcctccctgctagtcctcaagagtgtcaggcatgtccctccttccacagctttgctctgcttgttccctctcttggaatggtccaacccaaaaattcccataacttttacactcatccccacttcaggtctttgctcaaaatgccaccttcccaatgaggcctctgctgactcttaactattaaaattacccagaacttctaattctccttcctctgttctgtgttttctgcagcagttttcatgtaatgcagcatgaacatcttaaactccgttacacattcactttaaagacatgctatcttctaaaatgcaacacctttcttacccataaacttcataataccttggataatctagaggcaaaccctaactagggatggaggatttgacaagctcaactaaactatttctatttcaatcctggctcactagccattctaaccctctcaagcaacatgagaggtatacttgttctaagtatactcacttcccatcctgaccgccccctgccccagtcccagttgttatagaaacggacacttcccactccatggaagaatccgggcacggataacaaatcctgaactaattgcttcaggaagctccttccatctgaggcggatattctgggtgggtttagggcttaggtgatcatagtcaccttcaacgcatgcagtttataggggaaaggtgagtggggcactctgtgataagcagacactgcgatatgtgataatatgatgatgcattcttgagatacctaagtcctaccttgagatacctaagttccagatatgcaagtctgtaccatggaaacatacgcaagcaagcatcgggcctttttgaatggagtaacttcttcaccacctacaagttgggtagctaaatccccaccccagcaaagtagaatgtaagaaagaaggaaaacctatcccactccaaagagttcactggccaaagaattttgtagcatccaatctcggttgcggctgaccaagacaatctgatatggctattatatatttcaaggtcacgtggatttggccacatggaatataatttctggctggagcatgttctttcagaaagttggatgtgttctcagttgaaacactataggttttctccaattgcactgaattacccatcaggaattcctctaagcttggtgacctccttggttttgctcctgcaacgggacttagagtcaaatccccagcttctctttttcagggaggacaaggaattcagacagatgagaacaatgagagagagaaaggtcaccagagagcgaagatgaagagaacagaggaatggcagatacaatatgttagcatataaacacattataattttggccaagattggccctgtcggtaggagtttttctttgcataaagttttctctcagtaaataatagtctactctctcggtagcatctgaggccactgctgtaatgattttttaacttcataagtttcctagaacgttggtccaaatgaaggcaccccagttatgtctcagtcgtgtacctatagtgcgactgttgctgccatctctcagcagtccctggcaatgccacactgcttcaccatcagcttcaaagtgtccttgaagtatatattctgactacattgaatgggagtgccccatctcaacttgcaaccattggattcctgtaggatagaatttgtaaagaaaacaaggtttaatcaaaagcattaagagtctcttcttgttgacaactttttgttctaaggtaaccatatttactgtaaattatttttttaatctctcttctagtgacctacatgtttaaccaattgattgtactttgcatgaaaatcaaagtgttctttccccagtttacttttgttatcagtgcaatgcaaaatctgtttgcctgaattaggttgcatttcattaatctcttcaatatgaaattgtggtggctcatggttaatgagatttaagaatctgtgttacttaaattgtgactaacttattttaaaagtatgtcagaaaataatgattgtttctagtagtgttaaagtattaatgattagtaagtcttggtacacctgactgaactttggttagattaccaagtgtaatgaagtgttcaggatatttcagaattgagttagtatattacagattagtttaatctaatacaagagaatgtggtatctattagaaagacagacaatataaaataccagggaagttcaggggagggagagattctttcagcctagggcactaccctagtctcatggtcatctttcagacctagctcgtttcattcattaattattcattcattcaaacacacatattcaaaacctacaatgtgccaggtattgtgctacatactaaggatgcaaaatgaatatattaccattcctgctcttaaggtatttagtgtatcatatagtcatgacacagtgtttttaagtgttaagctaaaagtatgtacaaagagaaagagaagaggctaatagctccatcttgtgctggggtgacagcaaggagtgttagggacatcacaaggaagaaacaggcatctgcactgcacctcgacaatttgaaggtcaaataatagtcaggtggtggacaggagaagaatggaatctgacaaacggaattacaagctcaaagtcattgttacaagctatgtattggcatttcaaaggcaactcctgttgtcttcaaatatgctttaaaataatttaaacatctcatttatttttaaacagagccattgaactaagactaaacttagcaaatgatttacctggtcacagacgttcaagaaaacagtaaaactgttaaaatgaaaaagtcaaaacaagagtttgattgacacttgtctatttaaacataaccaaagtatatttaagggatgaagcatcctatatgttattgctattgatttttatggctatttattcatattttaagccttatcttaacaattctctgagataggactatagtggaggagtgaaatctcctcaataagaagtataatgctgagtaaattcttgtttctccctatcccctagatttagcagtatttacaccccaccagtttctactaagtgcatgcacacatgtgggctgtacaaacagttcctgggtcctactgtacacagcacagctgccaccagaacacgtggattccccagttctgactgtcctggattctagaactatacacatacagtaagtagaaatgttgtctctctcacatgctggttcatgcaagaatctcagtgagttcaatcaggggaggagcttgtgacataaaattaattttattgtgattaaatgcatagaagtgattagttcagtggatctgggaacctttgattatcacttgccagcctaatttccattttgtctttatgcaatcaggctgagctacataggtacacagattccatgcaaacttcaataaacaaaaaactgaccactttcatgactgccttgaatattttatgtttggggcattatttgtaataatttggaattagaaagtatgtatatctttttgagtatagtccaggaccttcttattcccttattacctgcagttgatgtcagaaaggaagtttcacatataggcatgttctgatgatttctggtattactgattcttgtccatttcctgatacctgaggtataaggtgtactattgtgctgagctaaaatctaataggtctctcttatcaagagttaatacttgttcatatttatctcttctggactcagttttcttatctgtaaaataagagtttagactaaatgaattctgacatttattcaagccgaaaaatattatgattcagatctcattgttccatgtctaaattctcctgttggcttcattgtgcccctaagccaagccacgttacttagccaaaaagatttcccacgactcaggtgtttctcagcttaacaatttcctgtctgttctatgacttgcccttctcatttccactgctaagttgtaaccctcatctgaaatgccctctgttcttccttctacctatccaaatccaatccatctgttaagaataaaatcttatgtatctaagtagtgtgtcacttcattcaagaagtcctgcctgattttttcagcccttccagtcatcaatttcactgttttctctaattacatattaaccctgtgttggattcctggattttccaggacaattatattattccctcttttccccatatctaagttctcagaagttctgcttctgaagtttttgttctacagcttaaattcaaaataaatactcgcttatacatttttgtattgttagctaattaaaattacaggtaaccagatggcaggagccatatcacatttcctttttgcccctcagaataggcattggataactacttcagtgttttattttaaatgaatcaattttgagatttatgttttttaaaaaagtgtcacaaatccaagttcaaatgtgtcctttgaaaatcctgtatattttagttttgacttgaatgaatgataataatgtattttaccattcccaggtggaaacaaccaagaaaaataagtgggattctggaacgctatgtattatatatgtcaaaccatacacatgattttacaatttggagtgtcatctataacagtacagaacttttccaggatcatatgctacaatacgttttacctggtaataaatatctcatcaagctgggagtaagtttatttccatcactttctctgtccccattccttccacttcttctccccttcccgtggtccatcttttctttctctctcacttaaaaaaaaaaaagtcaaaatcttcatgtattgctgtttatactgaaaactctcttcccatcctaaatgtgaattctggtgatctaatacctacacatttattttatattatgcaaatgatagaataacaccctgagtcagtagattttcccaagtcaaagttgggattatcaagattttcaaaattacttgtagaacatcataattgttaagaactttttctaaagtgctaggattcataaggttatttccctgtggcatttgtattcatttaaaaaacaatgcacagtatgaaaatttagatcttatatttttaaatggaagtttaaatgaccgtcaaatattcttgattgttattacattctggtttatattatgctcctatctcagaagaacagtcacttaataaaaccccagaatcaacatagtttagaggttcccttagacaaacaatagcattttttaaatgcaaaaatagcacttttacacaaaggtcttttaaaagaccttgatattactgtggaatttatactcagtaattccttttgttttttgatgaaatataatcttttttaagtttaatagcacgtctgaaaataactgaatataaacatgagattgtccctatttgttttaaacacactcttcattttatagcaatacctatataaggatatttgctttgataaatgccatagaaaatattctgctcttgattatgaataaatttacatttatgtagacactgtgtatgcattcattttacttaacatgctcttgaatgctctaaatattataccatgagaaaataaactacactcaactattgctaactgtctgacttaacaccacaaaacaagggcaatcagacagtggttaaaaaaatactgttcaaaactgactccatgtgcctaggtgttctgcacagcagtttatgaaacagcactttggttatgtacagttttattacccattaagtaagaaatatactaacttgattttcaaatgctaacacagaaatacaaactattttcaaaataatggtagtatcaaaattaggaagagtcttaattttttggaagcaaccaaaactaaaccaaaaattgtgctcttggttgtttatcagaagtaggcaaatgacatagaacagattctcttcctagggccgtttttaggatgtgctgtgcagtcaatcaattcatatcaatctcctagattttataaatctataataccttgaaaaatacatactagtagattaggagtcctctgccctgagtattaattcagattttactacaaactgtgtgacctaaggcaaattcacttaacctcactgagttttattttcttcaagtctaaaattagaacattgaactaaatgatgtttaatgtctctgagccataaaattctatgatgctaaaaaaagtaatcccaaacactattctatggagtcaaatgctatctgtcagccgctgaatagtgttgatgcaagatgttataaagatgtgaaaatccttgccttaactcttggtagggaaataaacttgctcacattattttcaagttcactatatttattagggcagaaaataatatattttcagggaggattcaactaacagggtttttacttaactctgttaagcagtaaattaaatgaaccagaacattttaggttcatcctggttaattgagggattattgtatatttcacagtttcaatataataactggctttcaaggtcattagattagtagatcgagagcaggttctcagcaaagtggagttgcctttatagatcattttagcatgtcgactaagagctggaaaacaaaacataaagataacaaagcctttaagcagcatttggaatagaggaagctacacggggatttgaaccactatgatttaccctaggcttggagcaggtatgttacttcatgtaacgtcatttagttttcacatttgactggattataaactgctgaaacataaggactgaatctttcaaaatttgatctgcagtttcaagcacagggcctattggaaatgggaagctgagcaaacaattcctgaatgaatgatcaccaaggacatcatttcataaaggttctaagacttttgatatgaattaaataatttgcttggaaacactggaattaggaatggtgtggttccaaaacatactctttccactgcaaaaaaaaaaaaaaaaaaaaaaaaaaaaaaaaaaacataatatgttgctactctcaacaaaggctattttgaaatgtgataaaatgtgatagctcctaataaagaagacaatatgttaaaaataaaataaagaagctattaatacagacagctatcaagacaggtgttgcttgataattttcataccactgctagccatttgtaacttgatgaattctaagtattatatattcctgaaagattcctggaagtggcttcactttttaagtaattatggatcaagtggcctttttctttttcttcgtgctttaaaatatgttgcactcttaacatccccaatccctgtggacctgaaaacttactggaaaagagaatgctagttttggtccgggcacactggcttacatctgtagtctcagcactttgggaggcccaggtgggcagaccagttgaggccaggagttcaagaccagcctggccaacatggcgaaaacccatctctacttaaaatacaaagaatagccgggtgtggtgctgcaagcatataatcccagctactcgggaggctgaggtacgataatcccttgaacccgagaggcagaggttgcagtgatctgagatctgccactgcactccagcctgggcaatacagcaagactccatctcaacaacaacaaaaaaagagaatgctagttttggattgtcttaatagtcatgatttcaaaaataattgataaaattttattatttatgcattttattgtaccaaaattgaatcccttatttggccagatgttactcatcatttcaaggcagagttatgcctttatgaatttttcaaaatggctgtaactgagaaaagctataggcgatggttaaaacaacttattttaatggctctcaggctttcaaagaccttgctatttcataaaggcatttttaatcaaccccactattttgtttagtttttccagaccagaattttaatcagcattcagctgtattgaatgtagtggcctctggtgcgggcaggtcaaacaagatactgattggttcaatttcatttagatgatgtcagattagaccaattggaagcagctttaagaacatttattttcccatcaaaggaactaagataatgtcctgcttacttaggaccctctaaatgcatccaaaaagaatgtgggcaaaacaaaataaaataatttgcaggtaattctgttatttcagcagcctctttataaataatttcatttacaagaaaaatgctttcataaatgccttacattcttaagagatttctttgtcaagttactggtttatggatctcagatgacatagtagatgaaacagtccttctaaaccaaaggatgcttttacttatcctagaagacatcataaaatcctcaaagtaaattttaattcacactgtgttttaaaaatatatacttatatgttgtatagtatagaatttatttggggagagttagcaggggaaatattttagtatacaaataagaaaaaaatagtgacaagtagactatcagaattaaatcccagtgtgttacaagtttaacaataagaagctgcaacatttttcccttctaaggaaaaaaaatctgaaaaatgcaaatggatggattttttttctccctgagaagtgggaaaaatttgtctttgaccatttttcctttgataactcagctgtctcatatggcctcttttcctgccatattttctggtggacttttagcacatttgaaatgtctggggtcttcaactttttttctattttaatcgttgggcaattattttttgagctcacagtgacctgtcctaaagctttgagtcagagtttggccacatttgcaaagattccattctctagaggagtatggtttttttcttgcacagaaaggcacatgccacagctgagaattagaggaaacccacagaggttaattaggtacccaatcttaatgcaattttcatgctcaggccacaatttaacccatctgaaagttgcttaattaagctggtaagaaattatcctgaagacatgggctattgctatagtcttgtaatagcaagtgagattaatttccatgtttgttgaccataaactgttgtttatgcttataatgaagaatttgcaactagttgcaacaactttgcaaatagtagtgtactcccatatttaaaaaaaaaatctaaaaatcagtcagcttccttctgtctttggggaaaagaatatcgactactttaagaatcacaaaatcactcactcagtatcaaactgaaaaatcagagagacgcctaaagaaagagatgctttaattttttatcttagtaatatctgtcttacacaaaaatgagctaaatatctctgcttttttacattgtcttatgattttgctttattttctttttgattttggtaaaatttagtgccttttgaaagatttttaaactttgttgtatcaattgaaattgtaacttgaagagatactgaaccaagcttaagtatagttttcaaatatcattgttatataaggatataattactaatatttgctagcaaatatgggctgaaaaccccttaatgtatttatcaatttcctggagaagtgcttgtccagtaagtttaaaacattatttgcagtttattatgaaattgcacacggaagtttctgtaacattcatgttaccatttctgacattagtgatacttaattagggaacagagagttctgtgatcatgttaaatttgtcaaacatgttttaatgaagcctatctactctgacacataagtaaattatgtgatcctttaagccattaaacattcactcaaaaattgctttgtatttgttgttttatgagaaacattgttttatttaattttatttggtgttatgctataaacatattggtcacactgtagaaataaaaggcaattgtatttgctgcacatcttttcttccctagaagtcagttgttttgtcttaaagtagtcttcatcctctagtactttacttatgttatgtgtacacatgctgtgtgtgtgtgtgtgtgtgtgtgtgtgtgtttaattcactctgggaacctttgtgcaaggctaacttcagcagggctgtttatccagtcaatatatgccctacatctctaggctctgacttaagatgcttccttaattcatacattcataccatctcagttattctctaactattggggatggctatcttatgtcttaaaaagcaaattaaataaatgttaaatcttaacactgaaatgaatttattttggggaagtaaaggtagcactatataacaaaatctgaaactcttattatgaattctctttcctcaatgttcatgaaaacttttgggaccaagagtgaaatgagcatttttgcatctctgtttaggcttgcacaggtggtgggtgcacagtgagtgaggccagtgaggccctaactgacgaggacatacccgaaggcgtgccagcccccaaagcccactcatattcacctgactcctttaatgtctcctggactgagcctgaatatccgaatggtaagtgaactcttttagcctcaagttaaaaagatgattagcaaaggtaaattaatattctaaatggcagcttatatgtggtgcttaatttttaatgatcattttagcacataaaatacctaagatagtatcattgtctctagttggggagattgtggtttttaggctaacacacaattttggtggctcaaaagtgctcccttttgatagtttttgtgtactgcatctcattgtttaatatgctccaggagaggtgaagagagcaaacggggaggattcccaaagaatgccgtagtgagagtgacattgtattttcaatgactttctgtttttaaaagccattagttcttccttggcgaaggagagaggtggaaagttcatgtacatattgtgtcaaaacgcttttgatttaataagtttatcttaaaagaggccacttggaactctgtattttttaatatactatttataaatatttcaacatgctgtttttaaacaatgcatagattaaacatacatatatttatacatatttagctggaggcaagttttgtgcatttctaagcaatatatatgtttttgtacagtttagtgaattaagctagtcagttacgtttcactaaaataaaatctcattatgaagaatttgtaatagttttgggtagaaattgctttattcatttagtggaaatatctttaaggttcatataacatagtaccattgtttcacactgatggaagcttacttgacattaaatttcattcctctttgagacaaatatcaagaagacttttaatatagaaactcttttaagaaactcattactgaaaattgaaatgggctcttttagcacagccaaaaagaatgaaagaaaaaagttacagttttattagtttgtcttatgtttactatgatattaattattccagccatctcattttaattaaacttttggcaaatgcactagatatatttgaggtaatggagagaattctaataatcagagtgaattattatctctgctattgaagttattcctgtactattacaaattttccaagaaaaaataaatggatgcctatttgataccatattaagcaatcaacaatcttgttatgcttcttacttcacaaagtaccctagttcatagatgacaatgaaaatgttaatgatttatttcaattggattgctgtgaaatgctgttacatgatttgcatagtagagcacttcccttcatcccaattggttaatacaactagaactacaattgctctcagaatcttcagctgttcagggaaacattttccacattacaaagctctttgaatgttttgtgtatttgcgtatgttttgtatatttgcaagcagttttaaaatgtactcatcaagcaagaagaatttgggagattttggagatttgtattgacacttccatggtattccaaagtcttgtgtttaattagagtgggatttttagaactttaattgtggtacaatggttagacatttaaaaggcagttttattttttttaaaacgactttttttgtttttactacttctccccactttcccccaattttttagctttttgtttctcttgttgattgtctagagagggataatctgattgttggaaaacatcttgtctctccatctgtcttcgaagtccccacacctctcctcaaatacccaaagaataaagtctaaattttttagtctggtattcaggttactaccaacttgtgactcaacctgaatacacattgccttataacatatcttcctttctagccatgctggaatatttatggcttaatgttgggttggaaaacatgggtggagtcaaataggcctagagtcaaaaattgtttctgatgtatagtgactgtgttacctcaggaaattcattaacttccatggaccccaatttccttgattagaaaattgagattaacaggctgggcctggtggctcacgcctgtaatcccagcactttgggaggctgaggggggtggatcatgaggtcaggagatcgagaccatcctggctaacacagcgaaactccgtctctactaaaaatacaaaaaattagccgggcatagtggcaggtgcctgtagtcccagctactcaggagggtgaggcaggagaatggcataaacctgggaggcggagcttgcggtgagccgagatcacaccactgcactccagcctgggtgacagagtgagactccatctcaaaaaaaaaaaaaaaaaaaggaaaattaagattaacaatccctgtcatcaccctgtccttacctgtagaaatacaactcattcttctaggctaaccgtaggcctcttattccatgaaatcattctactcttccttaagtttaaagtaaactttccctcttctcttgactatgtgaactgtttctatgccttcataatggaacttcattcagcctgtgcttaaagttatttgcgtatatgtcaaacactcccaccagatgctaaggaccataaatcattaatttctctttcactccgcagagcctaacacaatgttctactttttattggtacgcaataatatttaattcatttaatgtttcttgtggaaattacctttgatcagtggcatatatactccaaagccctggctctttaatgataccaagagagatgatagaagtacttaccatccagtgtctgcaatatatttgttcaaaatgcatttgttcctaaaatatatttttctagctgtgtagattctgaggctgggtttctcttttgagaataccgatcttgcatttgaccaaagaatttttaattttcttttctggattatgcccaattcaaagttaatggtaccaggctcacatggcaatatatgctacctaatggttgctttctaatttctgaatatgctgctgaagagaaatacaattggagaataagatagacttcattcttgtgtaactaaataaaccctttcaaaagattttaaatggtatttctcaaacttatctgattcttagaacaatcttgggagcaccaattgaataagtagattctaggctccaccacagacctcctaaataatcagaatcttccactgcctcggttatcatcaaaatacccctgggtatttactacattttccaactgagacctctcacaaaatcctccccctggatttttgttacatcttaaacccagcatatccaagttgatttctcctcatggtctccatctctctgcttgctctttctcctgtattccctctctcatggatttgcaccacccagccctgccagccagtatactgggcagcagtcttcaccttaaaccttgctcacccctgactgctgtcaccacacaacccctcgactgcacttctctagtgaaggccattaatattgctcacccagatcgcttcaggagcctcctcatgccatgcaaaaaatttgcatttgttcattcaaaatatgtattttgatgacctactaggttccttcactcttatctatacagtgcatttccttgcttcttgatctcaaggatatcagagtcctcggggaaaatatccatataaatgaattctcacaaggtggggaggtgcacaaggtgccaggtacacagagaagcagctcctagtggttccctatgagatgtggacatgtcatccctctgcatcctcacgaagatgttgcaggaccagatatagacatgtgtttagtctgaaacaggtattacttgcctggttttgcacactcaggtttcaaaatcttgactctgttaatcagttatgtacctaaaggtatgtttgttcactagggatttataaacatgaacaaagacttgttgagaaaaattaaactcaatttctataatgagaactaggtatatttttatgcttgcctatatatgacaaaatatgaaaggtataaaaagttctaatataaatgtccagtccttgccaatcaaacaattggtagcctttggccagcgtggcttaggaaacattctgtccttgtcataactgattctgacttaaatgatcatctcctactcgtgaaagtctgatggtaatccttaaccaatgctttaagaaaagatcctctccccttgttatttcagttctcttccttgtctcccagcctggtcctgctccacagtgtctgtgctggaaagcttgctagttggttcagtacatacttcatgagccctgagaatttttcctaatttggtgtcttttgttcagcagtgtaccagcagctccaagaatagtgcctgagacataataattgctcagttaaaaaattgttgattaccattattaaagaaaaaaacagaaaacaacatgttctggaaaggatgtggagaaactggaacccttaaatactgttggtgggaatattaaatggtgcatctgctatgaaaagtagtgtagaggttcctcaaataattaataatagaattattagatgatgtagcaatcccacttcttgaaatatatccaaaagaattggaaacaagatgcattgcagcattattcacggtagctacgaggtgcaaacaacctaagtgtctatggacagataagtagataagcaaaatgtgatatatttacacaatggcatatcactcggccttaaaaagaaggaagtcctgtcatacaatatgctctggatgaaacttgaggagattatggtaaatgaaataagccactcacaaaaagacaaatactgcatgattgcacttacgtgagtttatctatagtagttgaatgcacagaaacagaaattagaattacggttaccaaggtctgggtggaagggggaaatggagagttgctgttcaatgggtttagagcttcagttttccaagacgaaaaagttctacaactctgttgcacaaccacgtgtatgtagataacacaatggtacacttaaaatggttaagatgcccaattttacgttgtgctttttactgtaataaaaaaaagatacagagaggatgtaataaaatgctataaactaaactagaaaaaaagattaagaacagtgttagtttaaaacaaaaaaaaattgctgattaataatcacatagagatctatgcatgaagtatgcattttttaaacaagggtgagctcatactatttgagttgttgtggaatttacttttctcacttcacaatatggtgcaaacatctttccttgcagttcagtggaacgtgacctcattctttcaaaaggcagtatgcaatcccactgaatgaaactacagcttacaagacccatctttttattgatggacatttctgtggtttttgctattacaaacaaggttacttgctattaattgcctcagtctgccaagtacagtctttaagtactgagtcattatcacttgattcacacctaaggctttgcttgccttcaaatatgtcctgcttaattctagtcccttgcttcacatacctgcaaaaatgatggtgtgacactccagctctgtttctctaatcagagtcctttgcacccacgttccctctggcaaaggtgttctttacaggctgtgatttcagacatgattttaaaaccgctgaaaagagcgacttttaggtccaaggtctataggaacccttattatgtaggaccttgacgcttcctttgtaagaccattagctatcacagagaagtagcacaaaggattactgtctaatacatttgtgacctgtattgtgtagattgcaattgcgtaattaaagttctgcttttgagagcttccaaattctcatgagccatattcctttttagaagcttaggccttagaatcctgaaatatgttttttcttcacacttcaagtctaccttgctaaaacagcatagctatctgactatgccaaacttattcgtcattatctagcataacatttacagtgacattttaaactaattagaatatgtgttttttttaaatactaactaaaaatatagaatataaaatgtttatcttttattaatagctataattccttgtaactaacctctatctttacctaagtaaatcgacctaaaatagtttctttattagactgagccccatgagggcaggaatcatatgtatctttttcactgccctagtcctggcctttggcagagtgccacggagtagaggcatcttataaagctgtcgaatgaattaatatttaccgatgatagggacaataccaaaattgtaatagtgttgatgtgagaagcatattcatatgcaatcatacaacatacacaaatgcacactgtgagcacatttgatgattatgtaatataggtgggatgatttcaaagacagcagagaggaatcttcctcttggcctgctgaaggcttaaagcacacacttagagacctagtccttttgcttaagatttcatcagcctggtaatctgtagatttcctaatgaaagacagcacatagacttgtcttgtttgtgctctgcatgtctcagtatgaaaggatatgtttttactgtggtcaggatttgttaataaccacatgggcataattaagagagaagcatgtggctgggcgtggtggctcacccctgtaatcccagcaatttgggaggtcgaggtgggcaaatcacctgagcctgggagttcaagaccagcctaggaaacatgatgaaaccctgtctctaccaaaaaaaaaaaaaaaagaaaaagaaaaaagaaaaaaaaaattagccaggcgtggtagtgtgtgcctgtagtcccagctacttgggaggctggggcatgagaatcgcttgaacgtgggaggcagggtttgcagtgaaccacaattgtgacactgcacttcagcctgggtgacagagtgagaccacgtctaaaacaaaaaagagagagagggagaagcatgagagctgggcacccattagacatggtctagcatcttcttgagaagtgaaggggacctgagaagcttatggaaatattttcctaatttagtctttcatattggcccatctttgtgagaatttatatgtgaacatatgtcaaaatggtggcaatcatgtcaaaaataatagaaacatcttagcaggttgattatttttgtagacttacacgtagtaccttgaagacaatagaacgttatttaaaaaaaacatttggctcagtgttttgagcttatatattctgtcaataatgggtggtagagaaatcaattaactataggtctcttatacacactctatacatgttgtccttcacattaagagatgatgctatagaaataagttttcataatgtatgcacatgaagatatatgtataaatacaaattaaatattctatgcatgcatagaaataaatacttgatttcctgttaacaataataacattagtaataataataatagctataatttataagaatttgccaggcactttaattcccataactagcccatgaaataggtattgttatctcacaaatgtggaaacttagatttataagtattaaacagtttaattattcaaaatcaagacagctggttaagcagaaagattgtataaatcaaagcaaggtgtgaatgacaaaaattcacggttttattcactatattatctgcctctactttttgtagaaaggcttataatgtagaatttaatctagctgtatgaaaacaaaattttgttacttttacttgttcaatgtcctgttcttagtgccaatatttaaaattcataagatctgtgttctggtttttctctggttttggagagataactgtttgatatttcatttgattttcttactttttattttaaaataactttatttttaaatggtcaaaatgtgattctattttctttcctggaaatgctcagttttaataagtgaaatggattatagaactcagcgaatcacttaggaaaactgcttgacagttttgagcaaaccttgcgtaacttttatgaaacacctccagtcagtttgtcaggtagaatttcccaagcacagtcttttttagattccgttgattccatttttaggagagcataacagtaataaggcattatcccgcaatgtgaaagctcttctctcttttcctttttaattgaaggatcaagtattcacacagggagatatctgccacattcaatcagcatctggaccttgaggggagccctcagttcatattcctattgccatgctgcactggaaaagacaaacaaatatgtttggagcatctatattcactacacatgttatttttatgacacactaaagcattgttgtttaattcttacagtaaacacaattcttcagcgtaaatagagataccttgtattaaatttacattgtattgtacttgcattgaatttccttggttatatatgacaacctattgagcaccttaggaaatacaatttgacataacatgatgaagaggcacaaagatatatatcccagtggatatgctttatggacaattatcatccagcttccctgtgaaaattaaacaccttaaaaaccctatcattatggaaacagaaaggtgataaacttgaaactccttctgttgtacagccaatgggaattaagtatccattttgtggattatccattgaagaactgaatgtctagaactagattaaattaaactgaattaagccagaacctgaccccctttgccacatggcatgttacagttttattttgcttcagctgtcttactgattattagtgccagagaataagcaagaaaaagcctgaaaaaatacaatatggtacaatataatagagtaagtgattttttatggtgaatatttctcttttgcttttctagattcactctttttcaactctgccccgtgccctgtaaggctgaaccttcctcacagtggcaatgggcttcctctctctctggcttcctgttggtttgtccatgggcagcaacggcaaaagatgagagggtgagaggagcatggagtctcagaactcattctccctggctctctttctgcatggctctggattccagggttgcattcctccagtaaaggctacatttcctatttgaagcctctttctttctccaggttcctgaatttgttctcaccctttcctctaaaaacataaagaagtttactggctcctagccaactagttaaaatggtctaggaatcttagctagtactagctgggaatgctttattgtcactggttgctttcccttaaccctgtccgcatctttgtaaataggagttccactaaaatcttttccatgccatttgagttgtcattggtttcctgttgaaaccctgactcattcctaaattttatttaatccacatttaacacggagaggtgttttttgtgtgtgtgtgtttgtttttttgatgggggggtagtgcgtgaagataaatttaaaatgactttcttcatgctaagagtggcaagaataaataagtaaatgaacaaaatttccattttcttaaactttgtttcaatacaatagacatcttaaaggccaataagaagagccaagctcaaagattctagtggcggcttgcttatctaataaacccatcatatttaatttttcaaataataatcaacttattgatatatctttgaaagcttttcacttattgttataaaatatttctttgttatcattagtgaaataatggcttatgacatcttcctcttgatgaagtagctctgagtgccaagtttagcttataggtcagtttcggccaggcgtggtggctcaagcctgtaattccagcactttgggaggctgaggcgtgtgtatcacctggggtcaggagttcatcaggagttcaagaccagcctggccaacatggcgaaaccccgtctctactaaaaatacaaaaattatctgggcatggtggcaggtgcctgtaatcccagctactctggaggctaaggcaggagaatcacttgaacctgggaggcggaggttccagtgagccgagagtgtgccattgcactccagcctgggcaacaagaacaaaactccatctcaataaataaataaataaaattaaataaaaatcaaggtcagtttctcagataagccctattacgtatcctacccagactaggttagcatccacctctcccttctctatcccatgttttccttctatccatctgatttttaaaaagtaaactttacatcctcataatacctctaatgtctgttctttcgcttagattgaaagttttgtgaaggaagtaaccatgactgttctgacaacttctgtattaccagcatgcaacacaatgtctggctcatagtagctaccccatagttactgatgagccagatgactaccagaaaccaaatctaaatccagcagacttacaaaaattattttacagtatttagtaaatacttgtttctttgcactttctggacttcattggaaaggaatgaattttaaatgaaaagatagcatacaaatataagaaactattggctaatgacagatagtgtgccacggaggaatacagacctgcctaagcttgtttttgagagatgttagtttagtttttacaagagaagtgcagcacatgacataggtcagaattggaggagatagtctaaggtgagcttcctatagcaagtaaaactttaactcatactagaagcaaggggacagttctgtgtgtgtcccttctatgtgcacagtgcttattactaaagcacattcatatatgctcacttgtttgattctcagatcaactgtcaggccaccagggcaaggaatattaccccattttgttggtcaagaaatgaaagcttagtgagttttgctatctaaccaagttttaaaggtacgtggtcatgacagaagggctgaagtggttggaggaagatccctgaaaaagaagacaattggcttggaagcttttgactttgttttgaaatagttcccagaacaggagacgcactcaagaactaatttgttgattgaatgattacttacgtaaatgtatatgcacaaaattgatacttcaaaataattggccatacaatttatcctgttctgcaacttgctttttttctctaattcacatggagtaaacatctttttatgtcaatagcatagtgctccctcatttttcctcaaagcttagtaaaatgccattgaatgaaaccacaacatttatagaggctatctggtaaatgattaatatccattccttgctacagctacatctcattaatgccagctaaccattaattataaaagatgttgacaataaggtttggtgcttggactagtagatagtcctcaaatggattctcatttatttggatttggtatactccttgaggtagtgttgcaaggagtgtttagccaatagttatatcctgaggagtcctcaaggcctgaggagaggaccctgaactagctgttaagcctcctcctctaaaacaaagtcaaacaacagggttgaaagtcaaagaatgaaagagaaaagaaagctgatgtgcctattttaatatcagacaagactttacagtgagtagtattattagttataaaaatgtagtttcataataataaacgagttactaaaattaacatttattttttatcaaaatatactataagggcccacaaagataaataataagagagatgatatttagaacacatgtaaccatcagaaaactgtatccagaatatataaaacatgcctacacatctataacaaactggagttaacatctgaaaagtcatttcacaaaagaagaaaaattaaatgtctgataaacataagaaaatgggccaacttctgtaataatccaaaagtaaaagataatacccaaacaagataccattttttacatctaatactggcaaaaatttcaaagtctgacaataaggtctttttgaggatatagaacaatgagaactcacatggactcacatgtacactagaattgacatactttcaaaaagagatgagcattgtctagtaaaattgaacatatatcaacaattcctctccaggacatttgtcctagaaaatttgtgtatgcgcttcaagacacatatacaaaaatgtgtataattacattgatgtcatagccaaagtataaaaacattctaaatatctatcaagagtagaataaataaataacatttgccctgtaggaatactacacagtaatgaaaatgagtgaagtatggctactctcaaaaacatgtatagaacacatgaatatcatgttacacaaagcaagatgaaaaaattatatatacaacataactctattaatataagttagaaaaccatgagaaacttaattatgttgttaagggatgcatttctcagtagaaaagcaaggacatggttcttcaaaagtcctcatatttatctgtgaggaagggaaagggatccaattatggacaggagatttctggggtgctggcaacattctattttttcaacgtgagtgatggttacatggccttttgcttttaaatttgtcattaaaatagaattgatattgtatatatttttatatgttatgttttattacgtgatttttaaaatgtagaaagaataggtatatggaagccgtaaagttgtatgcactgtagagtctgaatgcttcagtgccgacacatagctctaccacttcctagctgtataacactggccaagttaccaaacctctctaaaagcttttcttgtcatctatttctctcatctaaaatagaacccattccactatcaagagtttttcctgaagattaaatagtacttgattaaaacgctcaatccagtgattattgctttagcataaacttctttggactttaaagtgtttgtgtcttcttacctggcatgctcccctgcacaacagtattttttaatttaaatattttattttgagataattacagattcacaagaaattacaagagacagagattccatgtatctttaattcagtttctcccaatgtcaacatcttctaaaactataatacaatatcacaactaagattttaactctgatataatcaagacacagaacaattccatcacaagacatggtttcttcttatcctcacactgaaaaacaattccctttttaaccaggaacagaagggtaagttagtactttggaagtaggcttttatgagattaacgtcattgttcatgtttgataaaggaacactcttttctgaatagtgattttatcataccatattgcaatctaacacattccatccctaagtgtcacaagttttttttttaattaaaaagaaagtatatataactgctaaagatatttcttctgccacagactactgctgaaatgcagcattcccacatccctgcctcattcacgactacttcctatacattcaggaaaagacgtctttaataattatttttcctgtttgatatttttaaccatctcactgttactacctgcatgggcttccctactccagtctattttacatgtgattctagattattttttctgtatatgactttatcttgtcgctagtcagttcataaaaacactaatggtctcctgtgcatcataaaatcccaactccttgtagtgtcattcaaggccccaaattccctttgaagttttgttttctattagactttatcgagtgatatggtttggctctgtgtccccacccaaatctcaccttgaattgtgaaaatccccatgtgtcatgggagagaccccgtgggaagtaattgaactatggggggcatgtttttcccatgctgttctcctgatagtgaataagtctcatgagatctaatggttttataaaggggagttccctgcaaaagctgtcttacctgctgccatgtaaaacatccctttgctcctcctccaccttctgccatgattaggaggcctccctagccatgtggaactggggagtccattaaatctctttcctttataaattacccagtctcaggtatgtctttattattagcatgagaagggactaatacatccagctacaggaataacaacagattattgatctatttgggatacctttactgaaccttgcactttcttacttctaggcagtggcaaatgtcattttcctcaccagaagcatcttcctgagacataggtatttcacatattacctttcatgggagacttagcttcatcatatgacttattgaagtccccactaccgtatgtggaagacttgactgctctaaaaagcctgtaacacttctttagccagagtgattattccctgctagagggtcctgtacctactgtctactatttaattatgtcatttgtttggcataaagttgttgtggtgcttatgatccttgtttaacccttgaattgttatttaattatacctatgtttaactcttttcttacttccataaaggtagatattattcttattctgttcttacttcccaaaataccaagtatagtactttgcacttgattgactttcaatatatttatattaatctttttattaggcttatcttgattgctttgagaaccagagcatgttcaccagttcttaattcaagtgaaattcctaaaaattttagaagaggaaattagaccagaaacatataacaagagtagtgaccagagtggggtaagatggccagtttccacaactaaatttatatttgtatggccctgtaaaatgggttagcccctctaagaatccattccctcctctttacagcaatgacaacaacaattcttattttttggagttgtcagtgttaaagaaaataatgcataaaagcatgtaccctattgtctgtctcaaagtaagtgatcagaacattttaattttcttttttaagaaaggctctcactttgtcacccaggctggagtgcagtggtgcaatcatggcccactgcagcctcgacctcctgggcctgagtgattctgccacgtcagcctctcaaatagccaggaccacaggcacatgtcatcatgcccaactaactttttgcattttttgtagagacagggctttgccacattgctcaggctggtctcgaactcctagactcaagcgattcacttgccttggcttctcaaaatgctgggattataggcatgagccaccatgcttggcctgagcatattttaaattactttaaattattttgggctggtggcagtggctcatgcctgtaatctcaacactttgggagactgaggagggtggatcacaaggtcaggagttcgagactagcctggccaatacagtgaaatcccgtctctactgaaaacacaaaaattagttgggcgtgatggcgggcacctataatcccagctacttgggaggctgaggcaagggaatcgcttaattcgcctcctgggaggcggaggttgcagtgagccgagatcatgccactgtactccagcctaggctacagagatagactccatctccaaaaaaattaattaattaatttaaaaaattattttaagtattctataattttgaaaatacttacatggcatttcaaggactcaaaatcttactttccccagagctactcataaatcaaaactttgtttaaaataaatgaaaacagaggtacaacataccaaaatctctgggatgtagcaaagacagtgttaagaggaatgtttattgtgctaaatagctacctcaaaaagttagaaagatctcagtttaacaaactaacatctcacctagaagaacaaactaaactcgaagctagcaaagattttttttattactgattcaattttcgaacttgacattggtctgttaagggttttaatttcttcctgattcattctttggaagttgtttgtttctaagaattttctctgtattttctagtttgtgtacatagaggtgtttataatagtctctgaggatgtgttttgcttgtttgttgttgttgtttttggtaggaactgcctcccctaccccgccgaaaaaaaagaaaaaaaaaaaaactggaccaggtggattcacacccaaattccaccagatgtacaaggaagagttggtaatgattctactaaaactgttacaaaatatcaagaaggaaggactccttcttaacactttctatgaggccagcatctctctgatagcaaaacttgtcaaagacacaactaaaaaaggaaactacaggccaatattcctgataaacatagacacaaaagtcctcaacaaaatactagcaaaccaaattcaacagcacagcaaaaagttaattcaacacaatcaagtaggcttcattcctaggatgccaagtttggctaaacatatacaaatcaataaatgtattcataaatctccttgagttggaaatatatttaaaaacatgattcatcatataaatagaactaaaagcaaaaatcacacgatcatctcaatagatacagaaaaagctttcaataaaatccaatataccttcatgataaaagccctcaacaaagtaggcatcaaaagaacatacttcaaaataataagagctatctatgacaaacccacagccaacatcacacagagcaggtagaagctggaagcattctatctgagaacaggaacaagataagaatgcccactctcaccactcttactcaacatagttctggaagtccttgccagagcaatcaggcacaagaaagaaataaaagaaatcctactaggaaaagaagaagtaaaactatctttctttgctgatatgattttatgcctacaaaacccaaaagattccaccagaaagttcctggaactgacaaacaacatcagtaaagttttaggatactaaatcaatgtgtaaaaatgagtagcatttctatacaccaataatgttcaaactgagagccaaatcaagaatgcaatctcatttacaatagccacaaaacagtaaattcctaggcatacatccatccaagaaggtgaaagatgtctacaaggagaactagaaaacactggtaaaagaaatcgtgtatggcacaaatggaaaaatgttccatgctcatgaagtggaagaatcaataatcactaaaatggccatagtgcccaaagcaatttacagattcaatgctatttctatcaaactaccaatatcatttttcacagaattaggaaaaagctattctaaaattcatatggaacccaaaaagagcccaaaaagagccaaagcaattctacacaaaaagaacaaagctggaggcatcacattactcaacttcaaactatactataaggctacagtaaccaaaacaacatgatactggtacaaaaacagacacatagaccaatggaacagaaaagagaatctagaaatacagctgtgcacctacagctatctgatcttttacaaagtcaacaaaaataatcaatggagaaaggactgcctattttaaaaatggtgctggggtagcttgctagccttatgcagcaaaccagacccctacttttcatcatatacaaaaactagctcaagatggattaaagatttaaatataagatctcatattataagaatcctagaggaaaacttaggaaacaccattctggatgttgtccttgggaaagaacttatgaccaagtcctcaaaagcaattgcaacaaaaattgacaagataaacctaattaaactaaagagcttcagcacagcaaaataaactatcaacagagtaaacagacaaattacagagtgggagaaaatattcacaaaccatccatttgacaaaggtcaaatatccagaatctataagaaacttaaatcaacaagtaaaaaacaaataacctcattaaaaagtgggtaaaagacatgaacagacacttctcaaaagaaggcagacaaacagctaacaaacatgctcaacatcactaatcatcagagaattgcatatcaaaaccacaacgagtaccatctcacaccagtcagaatgactgctattaaaaagtcaaaaaacaacagatgctggcgaggctgcaaagaaaagggttgaatgcttatatactgttggtgggaatgtaaattagttcggccactgtggaaagcagttgaaggtttttcaaagaacttaaaacagaaccaccatttgacccagcaacccattactgggtatgtacccaaaggaaaacaaatcattctaccaaaagaaacatgcactcgtgtgttcatcacagtactagtcacaagagcaaagacatggaatcagcctaggtgcccatcaacagtgggttgaatgaaaaaatatgatacatatacactacgaaatactatacaaccacagaaaaaaccctgaaatcatgtcttttgcagcaacatctatgaagctggaggcttttgtactaagcaaattaatacaagaacaaaaaaacaaatattgcatattctcatttataagtgggagctaaacattgggtattcatggacataaagatgacaatagaccctgaggattaatggcagggaatggggagtaaggactgaaaatctaactgttgggtactatgctcactatctgggtgatgggatcattcacatcccaaacctcagcatcacacaatatacccatgtcagaaacctgcacatgaacccccgaatctaaaataaaagttggaaaaaacagctattgatacatgtcctgtgttctagttaaagaaaaaagcatcttcttaggcttcagtttaaaatgtccactacattatatttgttagtttttgttactctgtttaggaatctgaggtcaatgaagttaaaattgtcatgttaataggtgttttagacttaccgcttattaaaagtatgttttaaagctgaatcatacagtgttttatattatattgattttgtttatattgaaatcagcttaatatgatgtgtgtgtgtgtatcaatataatactagtcctacagtgtggttccacaattcatccttcagcccttcctccatatgctgtcaaatactgtttacctacaggatgccgggtaactctgtgtttgtgtgtgtgtgtgtgtgtgtgtgtgtgtgatctcacctatgttaaagttagacttcattctcatccacctctcaattagatacatcctggatactaaaaagtttttgagcagttgaattaactgtcacaaatatcacttaatttcattctcagcttatttgccatgtattcatcttagtctaagcccttctttcaataactgtctgctcttcctatatccatagttccagatgtcaaggttatctagcttctcaacatagattgctaagggttgacttactagagtcagatagacaaaaaaaaaaaaaaaaaagaagaagaagaagaagtaaatttggagaaactgtcactgagagaggatgtagaagaactcaaacaatgacacaagaattggtaaggtgcagtcactgagtgatgtttagggtaaaagctgggtaagaaccctgtatctcatcaatcactgaagcattatagaattagagaatgtagtctttggtgtccataatcaaagtttcagtcttcacaaaatgattcaattatattcattatattctgtgtgagaagacaggtaagtgtgtagaacttactagaaggatttccttcaaaagtggttaagatttttagagttcatacttaaggggatgagatttagtttcaatgaaaattaacttctataaaatatctcatttcccaatatgtcagataaatgagatattatgcacataatcctaacataaaagacattctctgttccccaattatgtaagaaaagggaactattgatttaggtactttgtatctcagttaaaaagcaggtcaaataggtagcatttcaagggtcttatggtttctttaagagattctgtaacacactatttgtacataagatttttttaggatcaactgactgcttcacagagagcctgacatgtaagaattttttggtcattgttattacctgatcatatcttttttccctttaaattttctatgtattataggtaggtggtgttttcactatgtgtctttcacttcttagctttaactcatttgtgtctttgtgtgtcaagtactacatagaattaaatcaaataccttccataggtattcataaagttaccatagatggtcacaccagaaataaagaaaaacagatactggcagccacatctttttgtgtgtttagagctataagtggtacctgagagtaaaataaaagatctttcccaaaaatttggaaataagggaaatggacttatcagaatggtaaactatacaaggttgtcttcttaaaggaaaatgaatcacagcagtggctttttaaaagtattaactcatttaacaaaaaatgctttaatcctaaatgaatgtattgtcctagatctgattggtataagagaaaacatttcagatattcaaaacagagggtattttatacaagtaggttgttctcaaggtgttgtaaagaagggctggaagaacaaaagggaaaggtggcaggtactggatggaagaaaaggatgattgacaggagctggtgcttactgctacacttgccgatttgacatttgaaccattatgggacgctgccccaaccagagctgaaatgccaacaacattccactaccgaagaggcagaaaatgcagaagagatgcttcttctgtctggaatgcttgaggctgcaggtgctttgtcccctgctgacacagcagctgtcaacaaagccctcagctcttggagctagaaactggacgttttctttcttcctgcttctgtcctcctcacagtgcctcccactggcaaaacccaatagaaggccaacaagcaagagagttggaaatgtagtttgtagtttgtaggttcagccgtacagaacaggctatagaagcgtggatgtgtagctggggcggacgtcagatgaatcaccttcttagctactcggcattcacacacacccttgtacttttcaccacctttcattaccaatagcaatcactctatgcttccaatgaacatgatactactatgctttgtacaaatgacggtgctctcacctccctcatcacattcttatctgggtgatgttaattccccttttagttcaggcacaacccatctggatattcttcaacataaaaaaactaaactataaattaatacccactaaccctatttacatgaatcaatggggaaaggaggacggaaaattggctacaatatacaaatctctgtgtcataagcagaaataaaatatgatagcatttataattcttgtttatataattagttgtgagaccatagctgatatttacaacttcttctctttgccctcagctggtagttcatttgtttgtagttcttttatttttattttttgtagagatagggtctctctatgttgcccaggctggtcttgaactttggggctcaagtggtccttctgctttggcctcccaaagtgttgggattacaggtatgagtcaccacacccggcttatttggaattttttacttaggccactggatcttcattactaagggggtctatgtccttcctgttctatcttgattgggttgctgcagattttcaatgcttatatgattggacctggtcatataaagagatgcccttttgaatgtcctgactgacaatgtgcagtaggaagccagtttctcctccaatatgataccttttctctttgcctgttataggaatgctatgaagagagggttaaaaagaagccaatgtgtaccaggtgcttagaacagtgcctgatacattatgagtcatatagaatgcattaacaaataaggtcgatttacttctggggcatatctattaagaatatcttcttttagaaagcaatacaaattataagtatgcttcacttattaatttttgatctggaacacacatgacaacagttaacaggatgcaatagaaagattctcatgctggaactgttgggttctatttctgtctctgtattaattaggtttacagtttgatattcaagggtaacatctattttatcctttggtaagagacagagtttagacaaggagaaataccagagtctgtgatttaatgattccatgaaactagaaatcacatcaagagtgcttgctttcttaagaccttctttgctattgtctagtagtcatactgaaaggcaattattatcttcccaggtgttatcacgagttatggattatatctagatggtatattaatccacaattcctcagaactcagctatcgtgcttacggatttgctccttggagtttacattccttcagagtccaagcatgcacggccaaaggttgtgctctgggcccactggtgagtatctaaatttacattctaggaatgtgttaaatgtcagatgacactgaatattaaggaagaagtaagtggcggtgactcaccctctgcacagctagcctttcaagcaggatgggagatttttctttttataaaagttcatttaagagttactaagattttatattcgacataaatttcaagactgaacataggtccagtgaagggcagagtctacattttattgaaagaaagataagttggctagtgtagtaggcaaacatgaaatttttcctaatttagtgacatattgaaggcagatgtttttctttctaatcatgggctcaacatctaagtaagtttaagattaagaagtaaaaataattgaaagtccataagtgccacaatatggcaacactgctccccaaaaagtaatcaattaaaaggttgagtttacctcatctgttaggataaaatagtttcatgtgatacagcttcataagaatggtatttaaaattacatcaatatcagcttttgatattcatatttcagaaatctatatctgaaatgtatatctatatttcattagcagttaacagcttgacaagattatgttttctattcctaatataatttttcaaacccaattaatagcacttaattatcataaactagcaggacagtcttcagtttcaaaacatcacattacactttggtgcatttttcttgattaattagattttgcttctttagatggaaatgctcattagtcttagatattttttggcaatgtttgctaatgccctatcattttagtgcatgctgtcttcactgaagagtatattatataaatattaccttggaagacagctctatgttttaatttctgcttccttatttttgatcacacctctctttttgtttcagagattggttgctttccaagcagctaacaccatccatcggcggagctgagctgtagtctttattgccattaagcattttatagcccagacccctctgatggatacttacccttaaatgcaggaatggcaataggccagcttttcttatccattcaaaaaaaaaaaaagaaaaagaaacaaaagaacacgtcacatgagattgaaatttacactttttgaaaatgtaagctgcaaatggtagttctggctacaaaattggctcagcggtgtctcctgatgttctggcaactttaaataagggggacctgcattatcaacctgcatcctgcacagacagtagctacgttaaccttaagaaatcaaatgccacaaagctctgataggaaggggggaatagaattgggttgtaaaacctagtctgccatggcttcattcattccagactcaatcctgacttacagcacagagttattttctcccttggtacttttctttatgctgtactcagtatgcaaacgcttttccctagtcaatgatccatctctaatcactgggattgaagagcaatgtctttatttagaacaagtcaactatatgctaccaagaagttaaagcccatggtcttcaactggtttgtgaaatatttttgtgcccattaagtgattccatatctgagtattctaaatagccctggatggctagcacaatcatgaaggatattacagattcagcttctttttgttgatgattcttttaatgtgtccttattgacttaagaaatctatgaatcaatcttaaaaggcagagttttctatcattaaattatgatgtgatactcaacaaaattcagtcaaacgtggcaatggtgtacaacggtttcttaagatattcatctaaatagagcccgatgctatgacattttaaataaaaaatttcattgaaacagaaaatttatcatttctatttttaaatattttgctggcagaaatcagaataaattttgaaagagttcaatttttttgttcatctaatatttcttaatgataattcttgttctttagattatccacacatgcagggaaatactattcaatgttttctatgaggaatatgcttcacagtcccaaatatgatatggttcatcctccaaattgcaaattgttcatataataaaaaatatgaatttgatggagaatttttaaaaataaaaagacatacagaagttccatattcttaccacttgaatgtagtattagctcatttttttttctaatctgaccagtttgttagctattatttatggttcagaaggagttgccctgtacctatctggaaaaaacaaaaacaaaacaaaataaacagcagcaacaacagcaacaaaaaaaacccacaatgattctcctgtggtttttttcagttcttactcaaccaaataatgtatttgactcttatggaaatttcaatatagaaaacaattgacaaagcctttgaacctaatttttagatgctaatgtgcattgtcaagttaaattcaataaattggggttttataaattttgaaataacataaaaattaacagaatgcagcaggaactttttaaatgctttccttgctttcaattgtattagagggaaacccttcacattttgtaatattctttaataaaatacaataatgttttccataagaaaatcactttgctttcttactccccacttagccaatgttacataacactagtggagtctaagattgagaattttatgactgtgtcttgtattgtaacattcattggatcgattctccagggactcttaaggatgatatgcgagactataggtcattgctatgtgatatggctaaaaagttgtcttggttccttagtgatgtcatacttatacagataaatacacctggataaatacacatgtacaaacacattcaccctttcacattttttttttttgcaaagaagcaaataagtgtgttatttaagacatctaaatcttaatggcaatatataatatagtcaagcaaacgctataggggaagtctgccttcaacctgcttaaaccccttaaatccctatacccccttaggagatatacttattctacaaagcctcagatttctcaactattacaaagagaaataatgtctactttaagagagttggtgtaaaaaattaaatataacttacacaaatttctggcgcattgcaagagttttattaagaataacagtttatggccaggcatggtggctcacacctgtaatcccagcatgttgggaggtcaaagtgggtggatcacaaggtcaggagttcgagaccagcctggccaatatgatgaaaccccatctctactaaaaatacaaaagttagctggatgtggtggcgggcgcctgcagtctcagctactccggaggctgaggcaggaaaatagcttgaacctgggaagtggggattccagtgacccgagattgtgccactgcactccagccttggagacagagtgagactccatttaaaaacaaacaaaagaattacaatgtattaaagtgtttgtatgttttattgcacatttgctctcaaatattttttctgtgtcaagagaggttcccaggccaaagccaagccaacttttacctttcccaagtgccttttccacatattccttttacagcaaggtagataaacaaaaaagtaaaatgaaaaagaaagaccaggtcagagcaaaatagtacaattgccaaattcaatgtatagtaaaaactgaagtgtttatccaaatatttaaggaaatgttacaaaacatatttattttgaattaaccaaatatttgaggattataatataattatctggaattgcccttaattcttcaacttttcaagtctcattttatttggaatgctttaaaatcattctatgtacaataatatgaactatatagataggcataataaaacaaattacattgtcataaaatattaaaatgatgaattgatatttttctggcctagtttcatcatttttgtatgtagctattaaactaaaaacgaaagagcaagtgttatagttctaaagaatcccatagcttttctctgatgaaaataaaacatgttgtgacctcatagttattaaaaattaacactttctttttcacatttattttcataattgataaggtataatcaccctaacaaataaaggttttctaattgataatatttctgcctaaggatttcatgtttgatcacctccttgggaggcaagagcttgtaccttaagaataaagttgaaattatcacatatttagtaaattgtgaaaggtcaaatatctatgagtgatgctgatgagtttgtagtgattagttaactgaatttaagctaatgattaaaagatattaaaaatttctgaactcttttctactttcttgccaactacatcttcctctgaccacttattttacttatttatctattgaaatcttcctgaccccggtacagctagggattgcattttatttcagagtctttctcttcaaataattcatcttttgctcttttctgcatagcttcattaacacaatcaatatttttttgtgattgtgccttagggatagagtccctaggatgcatgtatttcttaatgttagcatgatgccatttttacataactgatagcaacatagctcataaaaattttgcgtgtgtgtgcgtgcatgcctgtacacacatgtatgcatgcgtgtgtgtgtgtgtgtgtgtgtgtgtgtgtgtgtgtgtgacagagaagagagagagtcaagatatgtggtgtagctttttgacagaggccagaagtctaccacctaagtcaaggacttataaaaacagactgcgtgcatttcttctcttttgcaatcacataaaaattattttaaagcagtcctagaattggtctatggatatgtacagccataggcacagtcacagtgtgagcagatccacatattctggaaatcacaaatagctgccttggtcaagagctcaaattctaagctttaacagcagggggaagaaaacatgaggtgtgctttgatcctgctgacaaaatgaggtattcatacaagatgctactgtcaaaatagtttacttcacagcaaaaagagattctttgaagaaatatgctcaaagcgaagcatgtacttattttatttgcaaacaaaaataaatctttttatactcacaggtggaaaatcgaactctagaagctcctcctgaaggaacagtaaatgtgtttgtcaaaacacagggatcccggaaagcccacgtgaggtgggaagcaccttttcgccctaatggactcttaacacactcagtccttttcactgggatattctatgtagacccaggtaatttgtttttattttctaaactttaaataacattagaaaacaactcatttttatttaaaatctttcttttggctaaaatctttcttttagccacagatgttggtttctttattttcctgaaaataacctatacggataagctactgcccgacggttctcagaatgtggttcccagagcagcagcaacagccacatctgatgaacgcttagaaatgtacgttgtagagcttctgccccagcctagtgaatcagaaactctagaggctaaggtctaacagtctgtgtttaagcaaaccctttaggtgacacatgctgaagaactagtatatactcttcttcccttgctaaaaagtggttcaaacctaaaacatcgtgtatgcaaagagttgaactataattttgcagtccatcttaaacaagccatttttgtgactgttttagatttctgaactatcttagtaattctgctgtgtgttctgataaatttactgaatgtggattaggctacatggggttccttgaaagtattttcaaaaactatctgattcaataagttaggtgctatggtagcatgatgtttattttaagcaaactctaccataaaaagagcaggtatatattttaatagaaactttggatctgtattaagtgctgttgtttatcatcttccaggagtggccttactatttttgtaggaggaagtttgaacctttatttttaaatgagtagcaaatatgcaatatcgtggattcagtcagacatgttattagcatgttagtctgttgcttaggcttgaaaacgtttctttgtttctgaattttctatgagtctttgtaatacttaataacatcctccaagtgtaaaaacaggtgaagaaagaaaaaaacaggcttttctaaatttgaaaagggtggttatttgtgtactgcactggcaagcaaatgcgagtcaagtgcgtgtcagagtctaagctgatcccctcaaagattggtgtgtcccttttttatgcaatcagggctttcatgtattctgctgtaaagcacttgtaagattatgaggtgaaggagtgatgatcgatttgaaaaaagaagcaacatttaggccggacccatgacagcccagctatttccgccaaggcagctgggtgaataatgcaagagccatattccccctcgtgtttaatcttgcattgtttttgcagagaaaatttctgcttgccttctaagtcatgtcatcttcagttgtcatcccgtctctcaaaccatcaaaacggtattaaatgttgcaaagctgcgcggcaagagaactttcaaaagtcagaacccatttaccgaacagcccttgtagaaaatgtattctgttctcggcagaattttccttcagttctttccactgagaagtttactgatttctcccagtggaatctgctggaatttatcggttcatggttggcagtcacagattaaggtaaatgtcgatccgtaatgaccctctacatgttagtattgcagtaaagctgggcttttatgtcaaagatatcggagagggagctattacacatgacaggggtgatcaagggactccagaccaaggcaagcattattaaatattgactagttctgtgatttatgtagagctggaggaaaaaagtgactttttaaccattatatattcttcagcaacgaaaaccagccatttatctcctgctggtaataaagaacagagtgcctgcatattttagtggagggaaaacctggtcttataaatgagatgaactccttcgtgataacatttcagtttgttaattgccaaaagcaaaacagacaaattggaagcaattacgagatttgacttaaagaatttttgcggtacgggttcaactcaggggttggaaaggggtgaggttggaagcaaaaggagcatctgagatgggccccaggaaaattcgtgtcattggttcactggcactggaactctcatgtccactgttaactgaaaggattttgaatattgtcttgtcctgtcacccatcagcagctgggtgacatttacactgagggtagggaggtctgcatggctctacaagaacaaattaaacattaattcatcaaacttatttaagatatcatctgttcactagatttatacaaagcttattgaattgtctaatggctaattggttatttccttgacataatgaacaactgtatttcatcctttcctgtgatggctgctaaagagggggtggttagaatttataagatagggaaattcagctagttcaaagcaagtgtagtttcaacataaaagtgcctgcagctgggtcactattttgcaggagaaattgggctgtgtctgtaagacaccctcatgggaaccctattcttcatgtcaactcgtatcctgaactaaaaactttacaaaaacattaggtttcgtaacaacaagtgaagtggcacgtatcaaagtgtgatttttcttaaaaattgttcacttttgaccacgtattatgttctcatgaatcaaaatttaaaagatagaaaaaaaggaagtaaagtaccaagcctgttctgcagtctcagaggaaaagtagtgtgctcagcttcttatatccttctagaaatatttgtcttataggtgtgtgtgtgtgtgtgtatacataaacaaacacatatttcccccatttgtaaatacatatagttttcatctcacacatgcaacattttatactaatgataccaagtggtacacattattttgcaccatgctttttttccatcttaataatttcagagaaattatcacagcaattcctaacgagcttcctcattctttatatagcttggtaatattcaacgggttagagcataccatcattggtttaaccagttccttattaatggccatttaatttgtttctaatcttttattatttcaaataatgcctcaatgaataaacatatgggaatgtcctttcacactttgcaagtaaattaatacgataaattccttgaaatgaattgccaggtcaaggaaaaatgaatttgtaactttgtaagatactgtcaaatttcattccatagagaccatataatttatattctcagaaaaagtatgagggtgcctgtctccccacagtcttgtcatcagagtgttgtcagacttatctttgccaattcgatatgttaaaaatggtagctatttcacagtatcttgagtagttattaggaattagttggaacttatgaacatattttcttaagtttaaaaactgtgtttcttttttttgtgaatgcttcatttgtatcttttgcccacatttttacagaggtttaagaagttctttatatattaggaaaatctgttatattagtagaaatttttcccttcattattgctttttcctagcactctactgctttcttttataaaatatttatattcagttcatctgaaatttatactgatataatatgtcatgtatgggtcaaaccttattttcttcccagaaaattttcctttctctcaaaaccatttactgaataatccttattgttccccactggcttgggttgtcatctccaagagctcctaaatttccatctttattaataaatacgtgtggacatatctgtacctttatttacattatcaaggtatcttaatgattaaaactgtagaatatattttattgccttgtagatctagtcctcttcattatttttattttatataatttcctacttattatttcatatttatttttttcaaacaatatttatatatttctaattttaccccagaagtcctgatgctgtttttataaggatggaacagaatttacaggtgacttaggtagaattaatatctttatactgtcgggtttttctgatcaatgatatcattatactttctattttgtgtcttttgtgtctctcgcaagagctcaaagttttcttcatatagatcttgcatatttctgttgtgtattcattaatattttataattatacatgatttaagtaattatgataatatatacattttacatattaacattaaaattaaataactgaaaagagctactttcaataattatatgtagacttcactcgcagatacctgtcttctgaaagccacgattttaaatgtttatatctattagatgatcgttcatctaacttttacaaatatttgaagtttttttgctgctaagattattgtcattttctctaaaatgcaggcatcttaccaggggaaaatgataatctaattaattagactctcaactagtttgtggtgtgtaaaatggcaacaaaggttggacctgaagaatctctgtcctgacagaatttacaaataaaaaagctaaggcagacaaacttagccaagttattctcaagtgcatgaggcaggaaagaaactagatggtgtgacaagtggaacagaaataattaagggaagattttggtaatactgggtctttctctttaattatggatgagaataaactgaatatggaaaaactaaagagaatgacggagagagcacaaacacatgtgaatggcaaaaattaacagatcaaccaacctacacttggttatattagaatgtatttttgccatttgctaacatccaccataaaagtaaggattagcacttttctatgggattctacctgatttgaaacatctattcaattatgaggaacatatgatcaacaaattagtttttctagggtgtgcaagtgccatttactgacctggaataagtgctttgctcaatgactctcaagggtgcaccattcaccttgcacaggtgaatagtcaactcccagtgatcactttacaacatcttcagtattttttcacacatatgaattaactatcaatttaaattatagataacaggtttataatcattccttgtgaaacatattgaatatataatttttaaaaaataaaacaaatgtgtaagtttgggaatacaaataaaactttacagcatagtagtagcaacctggcttatgtaaaactatttataaaattataaattctattccatttaactggtagatgaaagtattgtgccatgataatttagggttacatcattattttacagagcttcaaaagtattctcagctacaaatataaaacaacctaattgtcaagaagaaaaataaaaactatgaaaagataaagaaaatattctgagatcctatagaataatttttacaaatggcagcttctttactactagacttcccttggattcttcacactgatcctgtacttagtagacaatgccatgtcttagtacacatatcctgcttttttcttaagtggttattgtggagtcctctgcgaattgtttaattcttcattatccttccttttgaatgaattgggacgtgatcttcattgcttgatatcctgacagattgctttgtgtcagagtttctaaggcaaggcaccagcgtgtgctaattgctgagtcctttgtgcactgttaactctcacctgctctgaaaaactggattgcagcttagttttcatcttcaaatgtctctttctcctaatcccctattttgtgctgtgccacagaataaagatatttatttgaaaaagagagatatggattactgtgggggaaaaaagagggtaaatgaaaatgatccttaagcattagcaaagggaaatggcattttagaaaaacaaaagaaaagcaaagcagaatgatcagtttttaatgttgaaactgaatcatttcatggatctcagataactctttctgaatgtggagaggtacaacaaacaggttttaggtgacttttcccagagtaaatatgtctaatccaaaataagtcctcaaaagtaagggtggaaggtaaggaccgggaaagaaaggaaatggaagatagaaagaacaatttttaaattgttaaatgctcatgaaatgagcataatcagatgctttttatttgcttataagacctgatggtcctgaaaaaaagaaacccaattagtatttaagaatgtttttaaaaaggcaaatgaaaatttgggaaatatatctgttatctctaggtggttatattatgaatggtttgtcttcccatttttccttttatatgtactcaacttaaaaaaaattctataatatatacatattatttttgcaaaacattataaaaaatagctcacaagagcagatgattcaagagcagagtaatttggagtaagcatggtgcttctggctccaaggaggagatccgggtggtgagtcagaagtcctaaggtggaagcttacagaaagaagggcatcttcacatatttccaatgattattcaggaaaagtcttttggtgacttgtgggatgttaaatttaactttcttcttatgttttggctgcatatgtttttccaacagttgctaggggtaatcaaacaaaaacaccaaggattctgcaaaacagaaaagaaaactaaataggagtggtcagagaaataaaagagcctctttatacctgagacataatggtagtgttaggggaggactgaggcatgggagatttggtttttttgaggttacattgtggggatcaggaggggcataaagtttttactgcagtggtaacatctggaaggagtggggtgccttaaagaccgattaggatatttccaggtagaaaagatagagtataaatgtgatggctccccatcccccattctctgagcctaaactttttcttctgttataattggagtccatatctcatttcaatattggtatcaagtgtttgctctttgggataaatccccatctaaaaacaaaagaaattaaaggggaacggaaactgcagaaatgcagaaagtatttcattgctggtttaaactagatgaaagtgtatttttaactacagttccgaaaaatcctagcacccagaataggcttaccttctcctggaattgccagttaccagaaagagtgctttagaatgtcagtatattcaaatgctctaaatctctaaaaaatcttgaaaaaccaaagaaatgcagttgatttttcaaggttacccagagaaatccagtgtccttttcacacactctggttctctgggtgcttttctccccagaatatactgtgttttataaaaattacaagatggaaaaaaaatatacagaagcgtttattttcttgagaaggtaaggaaaataattatatgtgggaacctcttagacttccaaagagtctgtaggaaggctaatgctgttaggaaagggacagctttgttttatagtccctggtatctgttttttagtgtggagggaaatctgcggtttcagagctgtgcttgcaacccatgcagtatatctgacacgctgccctctgggaaaacccgccagtgggggaattgttccagtgatgcagtacagcttgtaacttggaatcccgtcggagaactttgtagttgcttgtcagtcagtgggaagataaaagaggcagcttcttttcaagcaatctgaattcattttcccgtaatgagttagggggtcaggcagcaggagtgagttcacctgagatcttataaagtatatttcctggtggaagaaagagaggaggagaaaagggaacataacgtccaccacgcagctgtagaacggcgtaatgtggcttgtcgttggtctatttctttttatgcccacatattctgatttcagagcatatatttttagaaagaaaggtcaaagaaagtacagctttatctcatttaaaaatataaaacccaatctgtgaaaattgaaacccagttaaagtctaaagcagcaagtgatagtgtttcatacacaaatactcatcaagcaacaacatgttaaagatattgtactatgtcttctgacattacatcattattaaccacacaatttattttagagacttagaagaaattaaatgagtgtcatgataaggagttcttttagttacagacaacagccccagacctctcttcctgaccatttcagatgttgtttctaaatcagcacaaaagatattaggaataaaaactgtgggagaatgttcttatggtcaaagcaagtattaatataaaaaacattgggaatgtaggggaaatagagaaaattactctgtttctatttgtttggaagcaaatgtctcttatgcaaaaaagaaagtatagttattatatctttctgtaagtttccaacacatttctggatgtataaatacatacaaatctaaacacttgggaaatcaaaaggcattttttctggactacaaattatggccatattgttaatgaaaatataaacgggcaataataagatatctgtcatttcaaatattgggctatagaatgtatatgcactgaatgtattgacacttctgattgtatatcatgtcatggccaataaagctatagaaatgtttaattaggacatattcttccacaagaatggagttaagcattaatttatcaaacttgtttaagacctcatctgttctcaacactcacacagcagcttattgaatttgtctgatatctaattggctattttcttgacataatgaacaagtgcatactctatgctgttgtgtctgttgaggcggcgatgtaatgatgaaatggaaattgtaaccatgggtcgtacactgattcaggatatgcagcccacagagccatgagagggcacaggatttcattgtcctcatggcttaactttatgtttcaaactctgcagagcatctctgtggaggaatctctccattctaactcctcatgaaaggagcctgttagaagcaaaatacaatcagcagatcacccagatgatgtacctttggctttggaaggctttgcataatttaaaaaataaaataaaattctcctatttagagaaatttttaaagcatttaaaaatactcacaccattttcaaacccacaccacaagtgatttgggggatttctaatacatgcatgataaagttcaactggataagccagccgtggggcagatatataatgtttacctatagttgtgtaccactgatatgcctgtctagtgttggtttttgcatgctttgttgtggcaagagttcagtgcttgttgaataaatagtaatattagaatcagtgtttagattttggtagactgaacatatagccattttacctaggaggttctcagtaggaaagtgtcagctgtgaattgatgttagagggaaacagaagaatggattacacagagaaatagaaaaaaaatctagccatctggggccaatgtccttctctagcctctaagacacaccctacagcaaggaattcccttctctgattcctgaacttctcctgtgggaatctagggatcaacttccttggatggtgatgggtccttatcattatacagagttatgaggattacaaaccatatgtttggccccttagaaagtgataataggtgactcctaaatcatagttctatataccaagaacagcccacatcaaacatatttcccaaatttttgtgtgaaattcttcataatcaatgtgttactttactcaattattagtgttgcagaatctaaggattctagtgggctatttatgaaaaaaaaagtatatggcttttagagaatttggattctttatttataaatcgggttgcaaataaaatttatgtttttccttctagcaatatgcctttggggagaagcaaagggagttttacacccaagaagcagaaatcaaaaatcatagaattaaattaagaaatttatttgtttatttggacattcattcatttgttcatgtagaaagcatgtatctagcttgttttatggaacaagacagaaactaaatgatagctgctggagttgagtagagaaattttctctatccagagttgaatcatatgttgttttattgtgctaaatttgttagacatttaaatttatacgaatgatggtgcctgtttctgggatatttattccttcccattgtaaacctatttctccaaatcatcactatgctaacttaatcactatgctttcaacatctgaaacatttagaaagtacttaaatatctggcaagcatggtctgtgtgctgaaggggcttgtggtttaacaaggggagctagaaattacccaagtaatcatatagaaatataaaattacagactttaataattattaaagtaaaagtatatataactaagattttcataataagaagcttaatataaattggagggtcaagaaagtttctttgagctgatgacatttagggtaactgtaacatgactagacaccaactcagaaactagaaagaggattccaaagtgaatggcatttgtaaaggatgtgaggaaggtaaaattgtggtggatttgaggaaatgaaagaaggacattgtagctaggctagggagtgaagaaaagaatggcacagatgagactagaaagttagacaggagctacttcatgcagcagactgttttaaggactttggcataaagtaaaagtgtagttgcaataattacaaaaaattttcaaattttcaattgtttttttttattattattatacttcaagttttagggtacatgtgcacaatgtgcaggttagttacatatgtatacatgtgccatgttggtgtgctgcacccattagctcgtcatttaacactgggtatatctcctaatgctatccctcccccctccccccaccccacaacaggccccagtgtgtgatgttccccttcctgtgtccatgtgttctcattgttcaattcccacctatgagtgagaacatacggtgtttggttttttgtccttgcgatagtttgctgagaatgatggtttccagcttcatctatgtccctacaaagtacatgaactcatcattttttatggctgcatagtattccatggtgtatttgtgccacactttcttaatccagtctatcattgttggacatttgggttggttccaagtctttgctattgtgaatagtgccacaataaacatacgtgtgcatgtgtctttatagcagcatgatttataatcccttgggtatatacccagtaatgggatggctgggtcaaatggtatttctagttctagatccctgaggaatcgccacactgatttccacaatggttgaactagtttacagtcccaccaacagtgtaaaagtgttcctatttctccacatcctctccagcacctgttgtttcctgactttttaatgattgccatcctaactggtgtcagatggtatctcattgtggttttgatttgcatttctctcatggccagtgatgatgagcattttttcatgtgtcctttggctgcataaatgtcttcttttgagaagtgtctgttcatatcctttgcccactttttgatggggttgtttgtttttttcttgtaaatttgttggagttcattgtagattctggatattagccctttgtcagatgagtagattgcaaaaaatttctcccattctgtaggttgcctgttcactctgatggtagtttcttttgctgtgcagaagctctttagtttaattagatcccatttgtcaattatggcttttgttgccattgcttttggtgttttagacatgaagtccttgcccatgcctatgtcctgaatggtattgcctaggttttcttctagggtttttatggttttaggtctaacatttaagtctttaatccatcttgaattgatttttgtataaggtgtaaggaagggatccagtttcagcttctacatatggctagccagttttcccagcaccatttattaaatagggaatcctttccccatttcttgtttttgtcaggtttgccaaagatcagatagttgtagatatgcagcattatttctgagggctctgttccattctattggtctatgtctgttttggtaccagtaccatgctgttttggttactgtagccttgtagtctagtttgaagtcaggtagcgtgatgcctccagctttgttcttttggcttaggattgacttggcaatgcgggctctttttttggttccatatgaactttaaagtagttttttccaattctgtgaagaaagtcgttggtagcttgatggggatggcattgaatctataaattaccttgggcagtatggccattttcacaatattgattcttcctacccatgagcatgcaatgttcttccatttgtttgtatcctcttttatttcattgagcagtggtttgtagttctccttgaagaggtccttcacgtcccttgtaagttggattcctaggtattttattctctttgaagcaattgtgaatgggatttcactcatgatttggctctctgtttgtctgttattggtgtataagaatgcttgtgatttttgcaaagatactcctcgagaagagcaactccaagacacataattgtcagattcaccaaagttgaaatgaaggaaaaaatgttaagggcagccatagagaaaggtcgggttacccacaaagggaagcccatcagactaacagctgatctgtcggcagaaactctgcaagccagaacagagtgggggccaatattcaacattcttaaagaaaagaatttttaacccagaatttcatatccagccaaactaagcttcataagtgaaggagaaaaaaaatactttacagacaagcaaatgctgagagattttgtcaccaccacacctgccctaaaagagctcctgaaggaagcattcaacatggaaaggaacaaccagtaccagccactgcaaaaccatgccaaattgtaaagaccatcgaggctaggaagaaactgcatcaactaacgagcaaaataaccagctaacatcataatgacaggatcacattcacacatagcaatattaagcttaaatgtaaatgggctaaatgctccagttaaaagacacagactggcaaattggataaagattcagacccatcagtgtcctgtattcaggaaacccatctcacgtgcagagacacacataggctcaaaataaagggatggaggaagatctaccaagcaaatggaaaactaaaaaagtcaggggttgcaatcctagtctctgataaaacagactttaaaccaggccgggcgcggtggctcacgcctgtaatcccagcactttgggaggccgaggcgggtggatcatgaggtcaggagatcgagaccatcctggctaacaaggtgaaaccccgtctctactaaaaagacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccagcctgggcgacagagcaagactccgtctcaaaaaataaaaaaaataaaaaataaaaaaaataaaccaacaaagatcaaaagagacaaagaaggccattacagaatggtaaatggatcaattcaacaagaagagctaactatcctacatatatatgcacccaatacaggagcacccagattaataaagcaagtccttagagacctacaaagagacttagactcccacacaataataatgggagactttaacaccccactgtcaacattagacagatcaacgagacagaaagttaacaaggatatccaggaattgaactcagctctgcaccaagcagacctaatagacatctacagaactctccactccaaatcaacagaatatacatcctcttcagcaccacaccacacctattccaaaattgaccacatagttggaagtaaagtactcctcagcaaatgtaaaagaatagaaattataacaaactgtctctcagaccacagtgcaatcaaactagaactcaggattaagaaactcactcaaaaccgctcaactacatggaaactgagcaacctgctcctgaatgactgctgggtacataacgaaatgaaggcagaaataaaaatgttctttgaaaccaatgagaacaaagacacaacataccagaatctctgggacacattcaaagcagtgtgtaaagggaaatttatagcactaaatgcccacaagagaaagcaggaaagatctaaaattgacaccctaacatcacaattaaaagaactagagaagcaagagcaaacacattcaaaagctagcagaaggcaagaaataactaagatcagagtagaaccggaagacatagagacacaaaaaacccttcaaaaaaatcaatgaatccaggagctggtgtcttgaaaagatcaacaaaattgatagatcactagcaagactaataaagaagaaaagagagaagaatcaaatagacgcaataaattttcaattgttacacagttgaatattagttacatttagtagctaaaggcttagattggagtgtcttttttcttcagagacagttttgttaaaatggtaccagttagaccaggtgcaggggctcatgcctgtacccagcagtttgggaggctgaggcgggtggatcacaaggtcaggagttcaagaccagcctgtccaagatggtgaaaccccatttctactaaaaatacaaaaaaaaatattagccggacatggtggtaggagcctgtaatcccagctactcgagaggctgaggcagagaattgattgaacccaggatttggagattgtagtgagccaagatcacgccattgcaccccagcctgggtgacagagcgagactctgtctcagaaaaaaaaaaaaaaaaaaggtagcaattataaatgtgttattggcttgcagtcattttttctatggagatatacatatgtgtattcatgtgtttgcatatataatgtattgagatcttactacaaacacatatcatattttacacatttaacattatatcatgaatgtttcttgtattacacacaaaaaactcataacaagtatttaatattcaataggtacttaatatactatagtatagatgtgccaacatgtatttatcaattccttattgttggatatttaggttttttattcttactatttgaaagaatatttattgttaacacatacttctacatttttccttaatatgtataacaacaaaggaattgctaaattaaaggttgagtatatttttgaagacacttgatatgcatggcaaaatgctttcaaaaaaattacatcatttcacatggcttctaatagtatacaaatgtgttcatctgtctgtagttatatgcatttgatagataaaaatggtaggttgctctaatttgcatttcttttattcctattgagaccaaacattttccatatgttcttttcctatttgtttgtctttctttttttgtctgctcacacactttgcccagaatattttagaggttttaaaatttgttttggtatttatggaagctaaaataatatagatagtaattcttagtcattacaattttaaatattttatctgatttatctttttggtctttttatgaggtttatgatgtagtacttcagatttttgataattaaatctttgctaatttatttttataaaaaatattttctccgtctacagttgaaacatatgttgctttattttgctaaatttatcagacttaaatttgtatacatgatgctgcctgtttctgagctatttatttcttctccttttacctgtttctaatctgattgaattgtggtgctttcaacatcttaattatttagaaaatacatttgtatcttatgggtaaagtcattattttctcccttcaggttattattcatttctgttaaaaggtcttagttcttttcatatgcatattcttccagttgaacattagattgagttgaaaaaatgacagcaatatttttaatggagtctccttcttatacattaattcttctgaaacttacatcttaaaatatttctcatctagaaatgtgttatttttccatttacttaagcagcttgtatctccattaaagttttgttattttccccataaggacctcacattttttgttagggttattccaggtatttttacttttgtgatggtgttcatttatttttattataatatttaaaaaatctctggtattacgtcagtgtttttaaaacatgccatttttattcaatactttaaaaatatttataaatctctgagttggcaatttctccagctctaggaagacagaaaatacacagatctgtacactcaaagaacgtgagtccagcccactcagtcatatgaacttagctggatataacacgttaacagacaggatagacatttttaccttgaacagaaagagctgtaattcaagttctgtgtcacagatacaatccgtacattatggtttctttaaataagccataaccaattttttttagtaattatttgcttccagttattcatgtgagattattaaaataagcttatgaagtaaatataagatgtttcaaatattcctatccattgagaaccccagaaattatccttattgaaatttttagaaaaaaattagataggtgcacaggaaaatccttataaaattatgtccctgacagagtttatatgtataataaaaatcaagagggtgggtgtttctaaatattcaactatatggattgaaggcattgtggtaaatccattacaaagattatactgtatatttgttgatgagaaaatatatattcttacagctataaaacaatgagcatcataaaattctatgattgcaatatatgacagtagatcatatatgtatagatgtatgtccatatatacgtgtgtgtgtgtgtgtgtgtgtatatatatatatatatatctgaacaaatatgaaggacacacaccaaaatataccaaaatattaataacaatgattatcttcacattttaggtaatttcagcttttctctttatggttgctgatatagccttaacatttataataaaaaaaaattcttttgtagttagacaaagaagaaatatgtgaagccaaaataggaaaacatgggggaaggaaggactttatatcatgtttcatctcatagcaaaactattggaagcatttcagaaacaaaagaccttaaaacttcaaactctaataagaaattgggaacaaaaatcttgagattgttatacaagagatgttaaagaccttaggcctcagtttctttcagaagcccagcaattgcaattattatttattatcactttacttttgcttgaatctctttagctaaaggtggtttacttccacttttccctaataatttatgtcttcatgataatagattttcttattatctttctgatttgtacctgtttcctatttaatgatttactctgtatggcatacatgccaaagttatcatgctagaaaaattattatgctataataattatgataccatcaaactgaattaaattatgtttcattgtaaatagtaaaatgtattaatttttttaaaagcttttttatgccagcggagataaataaagttacctttatgtactttcattaaacacaatgacagtacaagccaaactgataacaaatcaacgcactccttcttgtaacactcctaagttgttctgaaatcagctttcttaggactatgaattcaatgcaatgtattaaacagaatctgtgccttctgtgaataaaagtttcacctccatctcttgtgagtatatgtaggcagatctttgaacaatgaggttttcttccattgatttaaaatgaaaatgaacctggattttaaatgtgcattctaattgtccctttagcacatcagaacagcactgcctaatagaaatataatgtgagctacatatataattttgaattttctaaaatgcacattttaaaaaagtaaaatgaaacagttaaaactaatttagtagggcttggtgcggtggcttacacctgtgatcccagcattttgggaggctgagggtggcagaccacctgaagtcaggagtttgagaccagtctgggtgacatggcgaaaccctgtctctactaaaaatacaaaaattagccaggagtggtggtgcatgcctgtagtctctcagctactcaggaggctggggtgggagaatcacttgaacgtgagaggcggagtttgcagtgagccaagatcacaccactgcactccagtctgggcgacagagtgacttagtctcagttaaaaaaaaaaaaaaagtaatataccttatttaatacaatctatctaaaatatcattattttaacatgtaattaaaacctaaaagttaatgagataatacattattttttctaccaaatctatgtctgtattttacacttataggatatttcaatttagattttttatcagatatattcagtctgcatttagatgtcataagttttcagttgagaaagtagatccacataccaaattgtttcaaatgtatttaaaagttttccagtaactgaatcaatgatcaatttttaatttaaattcattaaaatcaaattagaaattcagctcctcagccatactacccacatttcaagtgctcaatagccatatgtggataggggctattgtattggacagcaaaggtttagaacacatgtataagatgttaacacagaggaaaagttaaaagttaaatcaatgccaaactattgggaatgttttgtctaccgggtttcaagaaataatgacatgactgatatttttcttattgaatcagctgctcggctggttggctcaactaatagagtcaaacagttgctgggttttataaacaaatcatctccttttttatttggtcctccaattttcttaaggcaaatatttgtgccaaattatgccaaagtctgtctctcctgaatatccctgttatcctcgaatattgttgagtgtcccatgaatataactgttaaatgctgttttgagttaaaaccaagaacacctatattgagaaaaaaattaaatgtagttaatgttgtaccaccatgttttgttctagcttctcaactgtctcatgtaaataagcacaataaacatctactgagtgattctgtaatagtttggatctataggtccatcatttgtgatgacacatagaagttggcccaggaaagctaaaagtatgtcatatgtcaaataatgccttccaccaagtttagagcagcatttcttccccagcattacaacttcatgtaatggcacttggcagtattggcatttctgatatgacttcttttggctagttcagaattcttaaaaaataaatagtttttcaccctgtgattgaaagggttaaatagtaccaattcattacactcacaaaaggatttattttgttctcataaatcagttttattccacatttttattattcccttgggtgagctactccaattgaaatcaatacaagtgcaagtgagacaatcaatctcgatatttgattatggattggagattcccaggtccgctttttagccagtttctttctgatcatctcccccaaagaactgaatatttttattgacatctatgagttctgaacatgtttagaaagaagataataatcttcatttgtatactgacaatggaagccccacaaatgaacaaggattaaaaaataaagacttaaaatatgtagctataacatcatcagcaaacttcaaatttctcaatatttttcttaagatgtagtcatgttttaaaataactttattctttcttttaaaaaaagacctgttaatacaactggtggctacaaaccacattcttagggtgctattaggtaaatgattatttttcatgacaaagatattatttattttcacatgcttgtttcagagctgaaccatatcaactggtctaggttaacaataagaaaacagttaaggtgaataaaatgcctttgaaggtatccagcctaggtcttttcatttctataattgtccaggctggaaagccaccatctgggggatttaaaagagaaaaacagctcaactttaaattagagagcaaaattgattaagttgttcctcaatgaggccaacatttatatatcaaactctctttgctttacaaacaaatttatatcttatgatcctttacatatcgaatgcttattttgggactcatggtaccatattattgttctcttgcctctgactctagccacctgttctaggttcttaagcaaaatttttgaaaaggcacaattaaacctttccgtaattcattatttgatacttagaataaggcaattatttgatgcacttatctaatcatattcttaaaataaatttcaaggtaatattaacactgcatttgttactttcagcaaacattttagccttatttagccatttactaattttcactagaatccattggaaggggatgtttcatgttttggacaaattacctaccactgattttttttcaggaagacatataactttgaatgttgtaaaaaagtattttagaaggagttaaaatagtaaacccatatttctttcatttaagcaacattaattactcttcagttactcttattaagcctttagaatagcagctgtataagccatataagccaggcacttggatttccactggcaaacttcctaggcatgtggaattaggggactgtctagaacttatttttgtccagcttcatttccttttcagtaatttgcatttattaatgctgaataatgaaagataatcaaaacattaatgaaggtatggtgcagtgatgtaacaaagggctatatcaacaaaatattctttccacgtgctttgttccactctttaaaaaaaatatttactcaagagaatcattctagaaactggaaattgctccctttattcaggaaggcagtatattttttaaaagttagcttctttaattgtttaattcagaggttggcaaatcttttctataaagggatagaaagtaaacactttagactttgcaggcaatatagtctctgccataattactcaattctgcagttatatcatgaaaattcctagaaagataattacttttgttctaataagcctttatttacaaaaataggcagctggccaaatttggcttgtagattgtagtttgtgggaccctgttttattataactcgtttatacattaaaatgcaatttacatactttccttggatatttcaatcttctcatgattcatttgattttgcaaaaattatgaatgctaatttaaaaatctatgtaatacagaaaaacaacatccactaaaatcccactacccataaataaccaatgttaacaaacagtaaacattattttagagctgtctcaattcatgggtgattcttggtagcaaacaacagaaacaaatttggttaattcaggcagagatgaattatattaaaggaattcaacagttcaaaaagttgtcaggaaagctggagagtcagacttgtggagaaccacaaataacatagcccagaccagcttatgccttcttaggacacccccactggcaccatcaccattcagtcgccttggaaaattatcactctacttctggattctcaacaattttagaggcatcttgaataatccttagttgactgtgagccattgtttcactggatcaagctttgtagtccccagatgaaagcaatgcaactgactggcagtcccatggtcttaccacatgaacttcaggtgtcctttcatttacaaaaaaagagaaaattaagttatgtttctaatcatttctttctacatacctattatcttctccctgattgttagagtttcttgatctttttacttatgcattaattatgattctctcaaggcttttcatcataccattgatttagattttagctctattctgttcctggctttttctaacttgtttattaaatacttactgcattttttaatttccagattgtttctctgtctctgcaatatcattttatcatattatagggaatatatatcattttttcccaaactacatggttattttgtctttttatgttacaatcctttctttagctgtatgtataatactcgatatattatttttttcttcaacttcatcttgcttatgccttgtatgggcagctctgtccagattttgcactggttctgagcttggtctacttcctttcctttctggtgctagtcagtcttctttcgacctaaattttgagcactaggtgttgctagagggtgcgaagatgcactgggcagaattctggggaatccagattttctgtctcctctgagatcctattatatagcttttgtggcagcacttgctgcatttattcacatgtatctcccacacctgggaacaccagctttttcccccaactcagcacagtgcttggcaggatggccagccctgatttctcttcctgtctctgcagactctactcagttcatttctctacatattggagaggattttttttggcttatactccttcctctgggaacaaagttaggagctgcgctatactaagaaggaatttaccatctctttcttcttttaggtttcaaaattcatgtcggtcatttttttccttttcctttatacatttgtacctggagaatcttcaactaaaattgttaatgttactgttttcatagtttgtttccattctgtcaggtattttggaaagacagttgtgtggtaccacttaatttagaagctgtgaaagttcacaatttgtccaaaatctctttctagcaaggtgattcatatatacagttcagagactaacagggagactgtaaggtggcatctgactttccccacctcctggtgttcatgtccttgtttactctccttcccttgggtgtcttcaaaacctgtgacttgctgctcaccagtagaacagaacaaaggtgatagcatgccacctccataagattgtaacctgtcttgctagaagactccctctttttgatacagcaagtggtcacactggggaggcccatatgggaagaaatgagggtgaacgccaggcaacacaaaactggtaactgagagcagccttgagtcaatagccagaaaaaattgagaccctcagtctcgacagcctacaacaaattgaaaactatcaacaaccacctgagcttgcgagagatccttcctcattggaaccttcagatgggatttcagtcctggccaacaccttgactgcagtcttttgagaccctgagcacaggacccagttagctgtgccagactcctgactcacagaaactatgagattctaaatgtatgttgctaagttcgtggtgataccatgacacatcgataggtaactaacacaggaacaccttactgtgtgactgtagcaaatgaaacaggtagaattcaacagcaaaacatgatatcattctcatccagacccccaagtcgttgctcttcttttacagaggaaccatctcaagtatatatcttccagtaattagaagaaaatgttaaacatgtcattaaacaaagaatggaccataggctttgtctgggatcaataatggttgtcaaattacttgtctgatcctagtagcaccacaggctcagcaggttcagcatggttagtaaggctctaccagaactttaaaaggaaacacgttttggtgataaaatagttgtattcatgtccagtgtttagtgtggaagccggagaccactttctatgagagtatatttgttcaataacttttagctgattgagataacagcatcagtttgttcagctggaaaaaagtttgcccaaatggcaaaaaaaataagtcaaagtggaaaaaaaccctgacatttcagagcatatatggttagtaaaaatagaccatacttctacaatttacaatagtcacagtacatctctgaatttactctctctctctttctgtgtgtttatatacatatatatagtgaactgtactgaattttatatatcgtagtgaactttatatataaaatgtataatatacatgcatatatacatatatctttcatttttataactatttttagagcagttttaggattacagcaatattaagcataaggtacagagatttttgtctatcctttatgcattatagttcctttctgatattcataaaatgagatacatttaggaaaatctgactgtggtacatagagagagcttgatggggaaaaataaaacatgcttcaacaaactttaaaaaataatttgcgatatttagaacagtaattgtgcctacacgttaaaaaagatctagagaacaaaacataaagattctcgatatctatagagttgtcattgctcttgtatgggcacaaccaggacaaatgtgtctgaagcatcttttggtgagttgataaaatagtgcatgtatttattccctgcactacaattgtcaggctagaggaatgaccaatttaaagaggagtcaaagaagtacagctttgactagatgacaactaattaaaatcactattacagtaattacagtaatgtaagaaatatgatgcattaatcgagcaccgtcctcagaaggtcttagtggttcataggctatttatttctctttcaaaatatcctgtggagaagacagcttcgtaggcatatgtccataaatattttatacattgtcaaaaacttaaggccaggaatagatttctttcaccatatattaattacaaaataaacaaatactcagcacctttcagattcctaccaacatgagatctatcagaaaaatggaatctggaagaaacacttgctttttggttaaaataatttaaaataatatttttagaaggaataaataaatgtaacttaaatattaatacagggtatatagagagacctgaaattcttggctcacagtaaaggctgattttgccagtttaccttgatcacaattcagtgtcttctgattttggtattggcagaatttcgtgatagtgagatggaactgaacaactctaaaattgagaccttaataccagaaaaatatagtatttctttgtacagcaagaagtgggaaaaattagttaataccttttctaccttaaggtgtaattggattcagaaaaagactaacttaaagcaggaccaggcctgacatataaaatcctcacgaggtaacaagaatcagtttggtttgttcactgtcatttctcattataatctttgtcatgagaatggattcatgttgtgccattttctgttcctgttacaatctttgtcacatgaataagatatcaggatgttaatgcctggcatacagtattgtgtgtgttatgatactgtacaggactacgctgacctttgcaatattatgtattctgattggttgttcatgtcacctctttcccacaagttaataaggctgtaaaaaggagagaactgaaatggccagccagtcaaattatagaatattgaaaaggtcagagcagtccagcacagagaaaaaaaaattatggaatatatggtgcattaaaattcttgtgacaatgattgtaacaagaataggaaaggatacccatttatgttattccaatctagagaaccccataggatggtattctcgagacagcaatcatttacgcatccctgagtcatacatgtgaaaatatccatttatgctgttttttccttaaaaataattgcatagattttctactattcaacaaaaaagagcattgaaaataagattttcatctcagaaaaggggcattaatattgttaacatttcagttaagactttatatttgagactaaagaaaaggtttttttataagtaaaacctgttgttcatatgagatttatttggtctattttttcatgtaacacttttctttgaaataaaataggagagtaggactgaatgaattaacctttttcaagaccctttagaatgtgggatagaccgaaagagcagttaggagtttatgtagaaattctacatgatctatgcaaaacttattttatctttatgatgtgtgatgttggccaatacacaaaaaatcttttcttcctctgcatcttcagtggaaagatagtgacagagagaaagaggtataatacttaaatcagaaaccctgatgttattgttcttaagtgtgcaataattacttatttttcaaattgtttttatgcatattttaaattttcttgtagaacaacttcattggattttgtagcctataaggagacatctgttttaaaccttagctttacacttatttcactaatagagtaaacatgttatagtccaaagctagtcaaagctagtgatcccagcaccctatgctctgatgctcatccagtaggcctggcgtagaattcagatatatgaatgtttatgaggtaaccccaagtgattttgatgtaggttgtgcctggaatattggtattggcaacctcattttgcaaagagctaagtgagacccccagttaaagcccaatggctcagaccaagccacagagggtggaggagggcaactcaacttcaaatcacagtgcttgggtgggggcgaagcaggcagtggggagttgcggttccagaactcagaagcttaaaaggtcttgcaccatccacttatactcacaaatagggtcagattggagggccaaccagacaggaatggtcgcctgcgataggacacacttatcactttcacattttcaagcttgatttttgaggctgaaccaacgaggctgcattttccagcccactgaaagcccagtttatgcagtgaaaagtggcaaagcacaaccatctcaacaagaggaacctgagcacaagcattttaaaaatctacccctccccgcccatattgaggagcccaaattcctaaagttcaaaggaagaaaggaaagacagtgagagtgaaatggaggaagagctaaaatctgtggatcctgctttggttttgaatctggaaatttttgagcttcattgagggctgaaatcctgtcagttactctaggtctgtgaattgaactgtatgtttgtaggggtgagagaacattagactcactcagctgtatagttactggagatgtacaagttcttttttgagctgagcaaaatggttatgtaattgcatacttctcataattattgagtaattatatacttcttataattactgagtaatcattgttctataactagaacttaatgttacaactaattatataattaccatgtattaatgttgttatctaggaagcttagaatgaagtgctacttatatatctccccctgccatgccattttcaaagcaagcagtagtgtttgttttttgtttgttttacagttcaaaatttccttaaaaaacaaacaaacaagcaaaatgcaatggaaaaaacttcaccaatattatactcatacatatttactcattgattttgtatttgtccctggctgaaaatttgtaaaattatattctcatggcttaattttagaatttccattgttgctttacaaatttcaatcttttataagacctgcacagttacgctacttgagagtcaattgaatatctgcttgagtctataggacaagctgacctttttgaaagtttacaattgagcatgtaatgacagcagaaatacttccaaggagctcaatatcatggggacaggaggagatctccccatgctgaccatgtaattgttcttaggcaatggttaggatggtcatatttaatcttaaccaggtttcttgagtgcaagaattatgtcttatgtacttggggcatgttctcgtcagtgcctagaaaagccttctccttgcatgcagttggagctcaataatcttcagtagaagcaagctgactagttgtaaagaacctaggaaagctaaaatggcataaattggaaatgtctttttagtgcataatgaaattatcaaaggctgctttgtaggtttcataatgtcttgctaataagtattacacatatagaggagtgcattatctacttacattttaggaccttgaaatcattctttaagctatgaatatgtctttatctgcctttactgaaagtgaatagaaattatcattgtcacgttttagcccacaagcactgtttatttcctttgaagtaaactacttatttggatgtgccaattttgggtccagagtaataaattatattatgccattagggctttcttctgctcatgaaaaaaactcctgagtattttgtaacagtagatttttcagtgacttcctccatccctaaatggttataagtatctttttaaataactttttgtatgtttttacaatttgttggacctacccatatttcatgaaaatagtcaagtaataaccagatatcagaccctcttttgcattatttgatcttcattaatttcagtttgaaatataatctgatgggacaatgacacattggtaatggatgagattagtgctgctttattcattgaaaaaccttagaattttgatgaataatacattgttaggttggaaggggtagagaataggtaggtaattgctactgagaaaatgaaatacagagtacaaaattcttaatcacttgctagttctgaatggctagaatgtatcagttgtatggattacaacaaaaacaataacatcattcctagctgttgtttatgagcaactattatgtgctggatatgataaagaaataatctcacttaattttcacaatagcactgcaatgtaaatactgtattatcattcccagttcacagatgaagaaccagacattcagaaatattaagtaaattagcaaagagcacattgctaaagaatacaagaacaagttcaaatgcaggacttttgacaaccaaatttatgttctttcctttgcactatactttgctactaaactgtgttaaaatataatgtttttgtaaatattgtaaaccttgcattttgtatactatacgatgcaagatcacttttagtatgatgccatcttttactttttaagcatttgttcaataaagattatatcagtatctggagatcttgccagtatgcttgttcttctctttgaagctcaatatcatgtgttttttaattcatttgtctatatctgcagaatttgtgtgtgaaagattgaatgtacatataataaaaagtggttttatataggaaaaaggttatttgaagtaaatattggtgctcttttagataaaaaaatctcactctgtgacccaagctggagtgcagtgacacaattatagttcactgtaatctcaaatttgtgggttcaagtgattctcccacctcagcctcctgagtagctagaactacaggctcataccaccatgaccagataatttttaattttaattttttgtttttagagatgaggacttgctatgttgcctagcctgggtggtactcttaatcattcatttttctgttttttaagagttattgtatcatttctaaaagtgacaaacattaagcagcatttaaaaaattgtctcataaatttttcaggaaagcatctaatatagaaaatgttacaattttcatctgtagcccttttcttattttaaccctaattttttactcttaacctgaaatttaacctaatggtgtaagagagagagataaaacactgttactaggcagaagtattttcctgcattttggactgatgagatttaagaatgggtttgctaaagctttggaaggacagtggtgttgggaccagggtgaggatgtattaaaagtgattcttttatatagctaggcagcttctgcattttctcataaagctaaaaatattagatcttctgatcaaagtggacatatagtacctcccatccccagttgcttttcaagatattctgactaattgaaatttaaaagggcattagatagaaagaaatccacccacatttcaagcaaagtgaacagaaaacacctcagtttgtgaaatatacaatatctgacaaatatgtctgagtataatacgtatatccagaacaattctatttgaggaataatgtgttatttcttcctgtctgcacatccaaaaaaattcagggatttttattggaaaaaaaaccctcaaaaaagtataaacaactcatcaagtaatcaatttctacatttgtgcaatacttttacttatatgcttgatacttgtgatatggctttatcctacagttatctaagaatattcatcaaattatttcgattgccgtgatgaatgaattggccaggtcaactcagatagcacttttgttcacaagataataaaatccaaatatgtgcattgatagaagcacatgtaatgcctcttagagtggtaaagttacagacctatttggtacagtatatttagaaactcaagaaaatactcaaataatagcaggaatgaattcttaaatatgtatttattttaataattttcttttttaatcagtaggtaataactacacccttctgaatgtcacaaaagtcatgtacagcggagaagagacaaacctttgggtgctcatcgatgggctggttccttttaccaactatactgtacaagtgaatatttcaaatagccaaggcagcttgataactgatcctataacaattgcaatgcctccaggaggtaagtctatgcaaatgttggctatctaattttatataaatgccctagaattaagtttccattgaataccttgtttatttttagaggtattttattttagaacttagaggctcaattgtatttctggttcttttaatagttgttgttttgctttgtttattcagattctttaattgacgatcttttattgttttgttgagactgctttcatccacctcacactgtgtgtatgtgtgtgtatataccatacacacatacacacacacacatatatatatctggatttctgcatgttaagaaaattgggaaatgattttgttcaaggcgttacttaaagccaaaatttatatttgcaatttgagcttccattttctactgcaaatggttctcattcctggtgttctaaataactagttcaattgtatacttaaagtacttcatttggcaaaaagggcagggtgcagatgatagaataggaaaattccatttgcactactggaaaacacctttaaattcctgatcctaataattacagttcagcagggccacattcatgtgtgaaatgtgatacagtctgcatatttttattttaaatatttctataaaaatcgacctattcacaattaccattattttgatgtgccttcagcttcaccatgttttaactcgttgcgggaaataatcgcattgaggaaaacccctctagggttgacatggatggcccttgaacagaaagcatgcctcaaaatgttaagagcatgactctcaattgagtgctaaagaatgtgtgttttctgaaaatcctgaaggcaaaggaccccaggacatccagcatctgccctgtagcccatctcccaggaatgagtatattctgaactaagggagaatgtcacaatcttttatcagcaatccgaagggcaggttaaccccacttccagttatgaagagtataagaacacaaagtgctttatcactggagaaaaataaaagggaatcttcagtttgtatggaaccgctcccctgcaaaaaagattcattacttgttgtatcataaaaccacacactattatctaccttttatgccattattaaaattaatgaattgatgtttactaaaatacttgaaactgtaaatgtcagaagctacattacttaagaaaagaatgcataaaagaaacttttgaggctgatcaactcaggttagtatcatatttattgagacaataattttaaaagggaattgaatttagatatatttatttaaaaattgagactgaaacccaaaataaaacaaactccccccgctaaaataaaccttaggtattcatatcttcatttttcacttcaatacacatgctaggaaggatagaaaactgtgatggctctaaaccttagaatataatatcctttactcaaatttagaaattaaagagtaatcagtgccataatggaggttttaagttatatagtaataccttttctacaggatatatacaatatttaataagcgtgtttattttagggtatttatactgattaaatagtttgtgatttacagtaatttatatcatattcataaaatagggcaaatttaattcattgtttatgtttttaggaatgtatggtctaataatttgttatttatacatatatcaagattcaattaaaaatagcaaggtcctactgctaacggaatatgcgctatgtgaatatacctgtcagtaaaagggttaatattatacaaatagaaagaaactaaaatattgttttatagtggtgcagtcaaactgagtaaaccattaactgaggcttatcttcatctttgctctgtggatgcttatctgtgtcattaccataatgcactgcaggcccacactctctgggcctgatgcaatcctccactttatgtattcagaaatctagaatttgggagtcagtccttcaccaaagaggaagcaaatgtcttcaaagacagacagtgattcgctaaagtttattatggccattaggacatactttcttttttcattagattgttgttgattacaattaggaaacgtatagctttaaaattatcttttttatgaccttgtggcagtttaaaggtgatacctcattgattaaataggttttagttcatgcttccttttacttaatgatctgaaaacatattatcctgatttacacataaaaatcatgctgaaaagcatgtggcattcactagaatatgtgtgtttaagtagaattaaattagtactgagagttattaaagaaatcttccatgcctttgtccagtgaactgtgtttcattctgaaatgaataataaatggaccaatatacggaggcaaaccaacttatgggcagagaaggttctatatgctatttacttttccattatagttggattgttatcattattgccatttccttgatttcaatattagatctctcttatggtgatgttgaattcctagtatctttcaatgctgggtgatgcaagatttgtgatgataatatccttagctatgcttcttttgcatacttttaaaacataataagaaaagagttgggcaaaataaaatgctcttttttacttcatcaaatatttgctatcaaatatgacctggaaaatcccctttacccgtttaatctggccaaatcctactcattttttagcctcaaacctagaaattggtctatcagaaagtcatgttttgccaacagaggctgagatagggcctttctgtatcccagagaacagttacattatactgaaattgcctgtttaatctgtcacaatcactggttataagatcctatagagtaggaactgtttcttactcacatttctatcttcagcacctagactaaacctgacacatggtaggtgcataatgaataattggtgaatgaataaattagtcaagattgcttaacgacttgttttaaattttaagcttattattactcaggccctccaggcctcatctcaacctcagcaaccttgtattttagccagctgtgaaagagaccttctctgtacaccactgtccaatgtaggaatgctctggttatgtagataaaattgggagctcaaactgtaaggagggtgagtgtattggaggtgagaaatattctcaagttatgccaactcttcattcttttattcttccctatagtggttacttttctcaggtgagcatagaataaacaatccttagtttagatagtaatttggaaaggagaggtgaaagggtcatactccaaagaattttaccaggatacatcatctcttaatttgtagtcaggacacatcttatttgccagtcctacctctatttttctgatgagaaaaaatatataattaagaatatgataaacacaagttatttgaagatagaaattaaagtaagaagatggtgctactaataacttggcacatagatgaacagtggcaaatcccaattaacacacattttttatttgaaaaattcactttaaatattatttggacaactggaggggcgtctctgttttttccaattatgtagcagatccttccctacttctgcacactcaagttttttgtatttctacaattactatatttttaggttgtttgtaataacataatgctcatatttagcactaaggtattcttggaaataaaggatatatttaatcagagctcttgaatagtattatggtacaggttcaagagttctaggaaaagaattaaaaaaataaaaacgaatccaaatgttaatccataaatatgaaactttcctatggcctttaccccttcaaggtctggagttactaatggggttaggatttcaacgcttaatggggctcagtgcattagtgttttgtatgcatggaattcagcattcagtttaataagtggttgacattggtgatgtcccttaatttgcttaaatctaattggctcttttatcagtcaaacctgtatggattggcaattgatcagaaagggtcagccatgactctgcatgtagttaaatgatggaagcaccagttaaagtcacagttgcatgataataagcaaaagaagaacaaatgagcttagaggaggaaggcaaagaagcttagaagttttgcaggatcttcaagttcagaacaaaggcattatagagtatataaattttaaatacactgcattttgcctccagacttaaacctttttttttccagatgaactgaaatcttgtctgaaactgtctttgttacatcaaagaactactcagaaagctaaaagagacagaagaagcataaaagggcatagtttaaaatgattagtgacaaattccatactgacgagctagaaacagatttttaatgaaagttttatattattccaaaaggaataattctgtttatctttttctgaactgctttattgtaacagtgaaaggaacttggagccaccctggtttgtgaacctaatccaattttcctctgagagtaaataatttgtcatttgtacttttaagttgatgagaattattataatctacaaacagtgtaaaatactaggcttgagaaaatctgtttatttgcccaaatgtgttattagagaaccaaaaattgaaaaaggcaaaatggttgcgagtagtttgttttacagggtcttttcgactctctctccttcccctgaaccccctctccacttatccacctaaaatatcaatgagaaaaaaaagaaagaaagaaaaccattaggaagtaaaacttaggcacatcgcaaaagcatagacgttggagtcctagaaacaaggatttaaatccacctctttcactcactgcttgagtgactatgagcaaatctgcagatataactgagcttcagtttgctcatccattaaagaggctggatggtaattcccacctgactggaggattgaacaacatattatatgtaatgtgtttagcgcattgcctgtcttggtaaacatttggtgcttcctacctcttttgttctattttcctactaagactctttttggggacctggaaaatgccctatagaaaaagtaagtaaaaaaacctgtctttcacatagactgcagagaccagaataatttcatcttgctacatccctatcctttcctacacttaccccttaacatgttgacatacatatggccaggccagtaaccctgctaaggggtggttgtgatgcatattagatgatgaagtaagcaggaagcatgggaagtgattttctttttgaaataccttcagcatcctcctccatgacctccagatcataatttgcgaagatttttacatcaagctctcattggtcatcttgggatttcacatattttcttaatagaactcttcttctgtgtttatatagagctacttattaaatataattatgactttttaaaaaatgtctattattgtatattttattcacaaatgcttttttttacattgttaatgctagcccaaagcaagtaatttgaaattttatcctaagatgttttcatgttttcttaattgtcctcaaatacatatatttaaaagttacatcttggaattcaaactttttttcatttttcactaaataggaaagtttactagttgttcagccaatatgcttttgaataactaaataaaatgtttgcttttaaaagatgttagtatatgatttttgcccaataataccactaaaggaataatatattaatgactaacttttttagcttgaactactgaattccattctgtttagaatttaagagactggaatattctttcgggtattgctgtgtaacgagtcactccaaaagtcagcaacttaaaacaaccattctgtattatttctcacctgattgtgtgagttgtcagcatggttctcctggcttaaggaggctggactgggcttcttcagaattcccagaaagaaactcagggtttcaagagtcaagccctagtgtacaagccctgaaaacctttgcttgcctcaaactgtccaaagcaaatttcttgcccaagtcaaaaagcatgtatgctggaatgtatgatttactggagcctgataatttgtcaatcttccataaatgtctaagtgattggtttttagattgtgtatgtgtatatgtacaaacacatacatgcaagtattacagatacataatttttcttttaaattagttctgcttttgaaataatgatgtactagcaccaaaaaaaatgaagaaagcagtttactaaatttttccttgaagaagatataaaaaaaaatctttccttacatgacaattaattttgatgttttatttcagtataaagatcaataaatgtatatcaatagattcttgtttaaaatgtttgtagctccctattggagggaaaattctgatctcttcttataagtaggtgatttaaaaaaaaatcttagctatttctcaaatctaggccttgggtattctgatttctgcttgtaactttgaactgtgagagtagaaactgtgtgtaatttgaatattttctgtagctccagtgtctggcataaactatttgctgaataaattaccagagccctttgtggcagtgataacttggaaaataatcctgaaagttatattttgctattgctgtgtcttttacttggataaacattttccagaattaaattcaacatttagggtttaattcatcctaaaattatttttagtcctgttaagattaccataacagtgtaaaaatacataatataggaccctctggaggtatgtttataaatttgtgtgtgtgtttaattgtctattttacctaccattttattttttatttttaaataattccatcttttatattatgtttaggggtacatgtgcaggcttgtcacatggatatattgtatgatgctaaggtttcaggtatgattgatcctattgcccaggtagtgagcagagcacctaatagttttcagttctttgctttctcccactgttccccttctagtagtttccactgtaaccaccattttcaattaacttatctattgtgattggtggttgaacacttaactgaaaataatgattaaaacagaacatccaaaaatttaaatatatattaaacacaactttaatttagaacacataaatatatttatctatatatttatccaacaatcttgttatatagggccaagttgttttcttggagtgttaatttagtatttataagtccagcatatttgctgccaaaactatattcataatgcatagtttgatttccactttgaaaactcctttaaaaggagaacaaaaatttagagataattaaggaagaatctaattatagaatttttcaggcttttgtaatatcctaagtcttttagttatttttcctgaacgaatttcacagtattgttttattaagtcctcactgaaagtttttcaaagcagtaaattttcatagaaaacggtttctgttaacagtgctcatcagtttaagcattatttaattaaatgacataatcataatgacaaccacaattgacatcacaggtttaaaaaatacagctgactctttgtgagtgtataattctacctgcgactgcagaatgttgcccttgaactacagagtagtcaactatccatctctgcaatacagagtaaatgtaaattttttattaatctggcaagtcagataagaataggtaggtaaggctgggcgcggtggctcacgcctgtaatcccagcacttcggaaggccaaggagggtggatcacctgaggttgggagttcgagaccagcctgaccaacatagagaaaccccatcgctaccaaaaatacaaaaacttagccgggcatgttgtaattccagctattcgggaggctggggtaggagaatcgcttgaacccgaaaggcggaggttacagagagccaagattgtaccattgcactccagcctgggcaacaagagcaaaactctgtctcaaaaaaaaaaaaaaaaaaaagataggtaggtaaagcaagtgtctactatttaggaaaaagacacgcttccaaagtggcagaatgatccaccctcagagcagcctacccaagtaggagaggcaggacaatgctaccaaattcttctcttaggttaagcattaccacagctctgccttaaaagaaaaaagaaattattgattatatcccttcaattgattagggactgagtctgagatttgtggcataacttgctcagtgaacttatttttctccttcagtttttaaaggaaagaactgagctttctcttctattttcaaatttcaaccaaaatctctttctaagaccttagagcaatgaaatgtgtgggtagcactatcaaccagccaggtggagaatggtatttttttttttttttttttttttgcagggtctctaagagaattaggggcaactagaactggctcaaaaagcaagaatatacgaaagagcaaaagagtaaataaataagaattgcaaaaacaaactctattgtatcttgcactttcttcatgcattgtagcactgagaattgtaaaatatttctataccttttgtttgtttttgttcttgtttttttgagacggagtctcgctctgtcacccaggctggagtgcagtggcgcaatctcagctcactctatgccttttaaaatcaacttagtacaatgtcaagatgctactttttaaaaataaaactaatggttctcaaaaatgtgaaagcttgcttgccgagtacagatataaagctcctcaatatgtgttttccatttttcatctgctctgtatccacttagatttatttgaaatatataaatagaaacattaatgtgcaggtggcaatgggatatcttaaaaattgaaagagtacaaagggatggagattttaaaaataaacgtaggttagcagctgaaataagcaataggctaagatggtatattcccttattcagagggtagaaggaaagatgagattaactgctttttataatgtaaaagccacaatgaagatacaggatggtgaggaatagcattctttaaaacgacaacattctaccacataaacagatggtttgtctttaccttcagtatattaaaagctacacaatttatattacatccagttcatatgaatctttcgaatagttgtgcataatgttttacttctgtgtatatcttccaaatgtgctgctattttttccctggaaaaatcaacccattgaaagtaataaagtaggagaattcaacaaataaaaagtatttaaattcttaataaaataaatagtgtgctttcaaaaacacataccaggccatttaatttaacccatgctttctcccaggtacgagaatagaaccaaaggatttatgactgtcttaaacatgctctcaaatcctttcctgaaaagtgttacctttacttttttggaattgatagtttaacctgctttgtgtgtgtgtgtgcatgtatgaagaggtatatgtttgtaatattacatatcataagccaaagagagggataaattcctgtttcataatttgtgaacaattttttcactttttgtattcaccatcttgacaatgaacttcctgcttataaaaacaccttagaaaaagactaacttctgagctatggagaagagggaaggaaactttgaagtgtgcttactatggactcaacaagcctccagcaaagggctgccagctctccatatttgcatactctcatgtggattatatagaaatacacacgcccacacacacaattaagtgctatctttaaagcatcctggggcaagagagagagacttaaaaaaataaaataaaatcacatctttttcttttttaccaggggagaggggtgggaaatattgttcctttaagttccattgatattttctaactcacatttttaaaaagaataagtacaattcattttctttttttttcttcgaagacggctttatccataactttaagcttaaaaaaaaaaatcatgtctgtctgactgacactgcagtctaaaagcaacttgaagttttatttgaatttttatagtgccctaaagaaatttttgctttatttctttaaaataatatcttgttcctcattttttcatagacaaactgtatgcctgacttgcataaaattctatgaacatttacctgcctatataaatactcacaaaagtgagaaaattcttaatatgtcttagatacttagagaccatatttccaacctcttttcatcagcagcatcaagaaaatccctttttctatctctataaaggcatatagaccccccagagtctaaaagaaaacttaaaaacttaaggaagaatagattttgacaacagtagggaaattcacttacaaccactatgcttttcatgattgttaattaattgggacaaatgaaactagaaacatgagggtatctaatatatactttattagattaatccctcttacactttgatgaccattttcaaatgtatactatctttcatttttatttaaatgtttcgtatgcttgtatcatgtcttatctactagatggggaagataaaacgaatgggctgggtgtggtgtctcacacttgtaatcccagcactttgggaggctgaagtgggaggattgttgagctcaggagtttgagaccagtctgggcaacatagtgagaccccatctctatttaaattttaaaaagaagaagtaaaatgaaaaaaaaaatgagtgggtgaatggaggtagacagaggagtcacagctggtctccctttttctttctctatccctctcaccatttaccttggctcaggcatataataggatattagtaatgattactatcatgctcttgtgcagtcctagtggcctggggctatttttgcacccagcataccttcaccctttcttttgatgacagggctccaatttccctctcagcaccctgggctctttcaagatcagaacatgcacatgcgctgtgtgtgaagttgactgcatcaccaggtctgaccaatgaggacactgtattctcctaaccacagtgattttttttcaggaatgacaggcattccaatcaaagccactgaattgcagtaaaccagtacagtaaacagaggcatgtctcttgccctgtatttgaatatgggattcggctcaatttgctgccagccatgttgcccctcaaagagtctgagaaatttagtcagcaaggaagaaagcagagtgggtatgagagaaggaggtagactagattctggtgacgtcatttgatcctttgaatccagcattgccaaaacccagctctttcccttgagtgtttttttgtttgtttgtttgtttgttgattacaggaacccactacccatctcattgcttaagcctctatgtgttgtgttttctgccacttgaaaacaaaagcatttgccacaatgcttgagagaaaggaaaacaagtagagagcatttagagaagtctcatcacttcctgaaaatcatgccaaatgctaaacttaacatatgtgtttggcttttgcttgggctctcaaattaggaaacctcaagaagtaagctggatgtcacatgagataatattttctaaaactgtgaaatggctcatcccattctgaagggtctcctcagagccacttcatttgacaatcttctgagctgtttctccactattttcaggtctcagagccctgagttctagtaataactcttgtgctaattagctgtttggtctgacttaagtaactttacctgactatgatgttggtctcttatctctaaaatggcagatgtgaattagatcagcagtatctatagtgtgatcccagaccaggaacttcaacattccttgaaatttgcttgaaatgcaacttctcaaaccctactctcaacctacttaaccagaaattctgagggtggggccaagcaatctgtgttttaatgagattccattaccaactcccaggtcactgggtgccttcacaagtttgaagaccactgagctagaccatctttaaaatactttcaaagaaaaaatatatgatcttgtctatgactttattccatattcatatttgagacaaatactcagggaaaaataggtataataggcctccatgctcaactggtctttgaatatataagtcacattcgtagggccagaggtctttccaatgtaagaaagccatcgtgttgctcacagtcttcctgaatgggccaggaacagataccaaagataaccaattccagatgttgagttctacctgtggcaccagaaagcaacaggcatgatgttttatgcactggggaacactaatcagccctactgtgaagacactgtcagctaaatttcctttgctcttcaacttcttcacagaacatctgctataagaaactccttgtaactaaaacctgagtctttcccctctggggaattttctttaatgagcctcttgtggctacatctgtacagttttgaaatatgtttcctcaagtcagttacatcttcatcctggattctagggtttgctgtctattggacctcatagctaagatttttccttctaggagttcacaaacacaactccagagtaggttgacatagtgcccagtatctagagaaaaattaagatcatgtaaccttttatttgctaaaaagagatttttgatgttgtgatcactcataccaagatagcatttattaatactaggtgcaggtgtggttttgcatatattaactcattttattctcctcacaaaccctgtaaggcaagtgctattattatccctatttacacataaggaagttgaagaaacaatattggcttgcaactagtaaaggtcatcttactagtaaaaggcagacactgtatttaaacctagagactgactatagaagcctagttctgagccactatactctattgttctactgactgtagaactatactctatttcttctactgactgttcatatgctctcttggcagcagcaacacagattttgatgccccactaatcaatgcagatctgaagaggtgacttgactctatagtagggtcaaatataattttaagggtattgttggttgaactagtaggtttttaaatcctgttgcagatggcctagagaactgtcctcagtgactgtataacccatgctctaaagtttataatgtcataagagaaaaaaaatgtaggtaaaacatgtttacagccttacaaaaaagcattaagcagaagcaatattatgtggtacgtaccctgtgtggagaaggcaaagaaaccaaccagttggactcatcctttgccagtgtggatataagtacttaacttgcccaccaagtattttgcccaacttctgtcatatttacctatgaacttctattataaattattataaattgtgatcttctgattgtacatagtttgcattcttgtgaagagacttaatttatctaatagtgttaattttgaaaaattaacaaactttcttaaaagagagcaagaaaacttatatttgtaaaaactaatgaaagaaagaatctttttcttcctgtactaaaacaattttctgtgaacagttgaaaaaacactctagtcaggtgaagacacttattcatatgtggaatattctagaaataagccatgtgaacagtatgagtatgtgggaaaattgttcactggaatggccacaaaatgaccatgcgtgacctctgggccataagaaagcaggaatactttcctcatcaaaatctgaagttgagggcatgatcacaggaaaaagcttaaatcttattcccatggttgatgctataaatcaagtaagcgtgtatcttagactgtgcatttgtaaagcacagtgtctatcaaaatatcacaattcaacttatccaccacttgctatccccagcattttcatttcctgattgtgtgaccttgagaaacttttctcctctctaagcctcattttgctcatctgggaaggggtttcataattacagaactttcctcaatgggtttagacaaggaataaagaatgtgtgtgcactgagattagctggcacattaggtagctgctcaattctttgtttaaaggacataaagcatgatatataaatacaaaatatatgtaagcttatcactattcagttgaaaattaacctgtaaacatctacatttttatcttctttgatgattccaacagctgtctctaaaactaagtgtaaggaaacagcagactggttgtggcatattaaattataagtgaggactaatttgaggatcaaagatgctctttgggagatatcgcctgactagtaggaaaagcattagctgtctccctctgtctcatgtatttgttctctctgtcttggaaatatccttccccacagtttctgaatcttgatgtttaattgaacacaaaggtctttgagaaacacaacagggggttgttcctggtagttctagcattgaggaaattgaaatgtacattttttttctcatttatcaaagaagggcaagaatctaaactgacattttatatcaaatgaattatgaactgtgtactttgtacctaagggaacaacaactaaattagagttttagttaagagagagagagagacaaaaataggctttgaataaaacatacagtaatttctgctactgtgcctgacagtgacatggccagatacagttctattgtagaactagtgactggatgcaggctactctgaaatctttaaatgtatttgagagaccgtctcagaaaaaattaaacctaaatttcttatgttgttagactttatggtcagtgaaatagtcttgataatctaaagttaactttcagctttttatcaatgcttactttcttaaaaaaaataatagttgcaaagttttacttcttgagaaagtatgaaattataggttgcttgagagggaaaatacaatgcagaataaaaataatatatatgaaaatgccacattccatctctcctctgattatctgtaacacctacacaaatactacacactacactcatatgttattgtgctcataaagagtgtgaatcctaagatcagtgggacttggttcaaatcttaatttcccccctcctactagctgtaagagcttcggcaagttatacaatcagagtctgctttactttgttcttctgtaaatggtagtaaataataagcactatctcacaggattgacactgagaacttaattatgatgatgcctgcaatagatacaacgtgatgcagtacacatagtagttgttacgttgcacagttgtttccttccctatgtgagaagattaggcagcagcaaattagaactccattatttaatggctgctgattcctgaagtataggaagtattagaattaaaattttaaggagaaggaccctataatgtctgtgcaatatatctaataatcattttttaaataaccaattgaaaattcttgggaattgggggtgattcatgctttcttcttctggacaaagctatgtattgattaccatatttttcttcacaaataagtattccaatttatgcaatataaaaataaaagaagcgttattaatatgaatacatttgttttagacttctaaatccccctaggttcataaacctaaaagtgacaaaattccttgatattaatcccatatgctttctgatgccaatgctatactggataataattttgtgactaaattactagaaacaaataactatcactgatagcctgattacaaattttcttcatataattattgatcattgctgtggtaaaatgaatatcataatttttattctcaaatgttgattctaactctactacttataaggtgaaatcagttcttagaagtctttcagcagtttaaattctgccaatgactattgttttattcttactaatagataatgtgaaattaatggcatgttgaggtaagggatgctgtcttgtccgtttaggcggctacaacaaaatactatagactaggtgccttacaagcaacagaaaagtatttcacacagttctggaggctgggaagtccaggatcaaggtgctgacagattcagtgtctagtgaaggctcttcttcatagacagtcattttctttactctaacttcacatggcagaaggggtgagaagtctcccttgggtctctattacaagggcactaaccgcattcatgagggctacaatatcataacctgatcacctcccaaggctccatctcctaatattatctccttggcggtgagaatttcaacgtaagaattataggagggacatagaccatagcagacaccccacatttaagtattttaatgctagatctagttagtatttgagtaatttaattaataaacttgaatattatatccaatcccgttgttacaatgacttttataaccaatctgctctgattcttcaatcattaaatgactaaatttttctccactattcaaagatcacttaatttcttggtatttgattgtatcttagaatagtggattcaatggcaccatagaggaagagtccaactctaaaatataatggtttattttctacacgacctcagtcattttttgttttgtttttgagaaaggctctcactttgacaccctggctagagtgtagtggcacagtcacagctcactgcagcctcaatctcctgggctcaagcaattgtcccacctcagcatcctgagtagctggcaatacaggcatgcaccaccacatccagctaattttgtattttttttttttttttttttttttttgtagtgatagggtttcactatgttactcagactcgtctcaaactcccgggctcaagcaatctgcccatctcagcctcccaaaatactgggattataggtgtgagccactgtacccagcccctcagtaatttattttgctatttttcttgttggatacattcaacaagggataatttaatgcagtcttcctgaaaagagtggctttgacttgagcttgaatttatttattgttaaccttgctaagcatatcaatttttaatttcacaaagactaaattcttcagtgaattattttaaatgaagtcaatgagcaatattagaatcaaaaataaaatagaattaattgaacagtattgttgtatatattttaaattatttttccaattgaagatatgctttaaacaaagggctcaagcaatcaggtactcaaggaaaaagaatttaatctatgctgcctagaaactaattggatgaatatgatcgtattcaaaataataggaatgctaagaaatgctcttaggaatactaagacgaattcaaatgtcgaaagcaaaggcttaactagagtgtctaaatgtaggaagtctctgtaaggaaaaggaaaaaaatttggttggtggtttgagacataacaaaaaaaaattcttctgggcattatgaccaccaacttcagggcctctaattagtctgacaaagtgacagttctacattctagttgaacaaataatgtatctaatgaaattcaaaatcgctatttttctctgagcacagtgagctgcatcattcacagctttggggtatttcaaaattaacagaggatgacttcagtctgtctgatgtttcttggttaacaaattcactgaaattgtcttgcagagcaattttaagcaattctttaatcttaaaccacaaagagaggtggaggtggaggtgtattaccttggtcctatggatgctaatgtgaagtggaatcttttatttctcaaaatggtcaacagcaattagtattcagtggtgtctttttattctggtgcccttgacccacctctgcccccctttctatattactcctattatatactgtaactggggatattcttgcttcttttccattctaattaaagcattcttagtgaacatgggaaccatttttcatttcatgaagaataattactggacctaggtgaaatctgcccattgggttttatataatttttgacaaatatttgcacgaattttgactgatctattcttaccatttctccgtgaaatgttggagaagttttcagttccctcagaacaataaacctaaatatgtacgtgaaagaccaagataaatgttgtaccaccttcaggttgtatttgctaatgtactttaaaatattttattttgtcactaatataagaaataatgatgactttttaacaatttttttttttatttttgcacatgtttctttcctagtcagagtttgacctaaatactcttctactacactagtgacaaccttgagaaatatcatttatttaggttggatctgtaaaacctatagctcttgttatacatcttgtttcttttttttattttattattattatactttaagtttcagggtacatgtgcacaatgtgcaggtttgttacacatgtatacatgtgccatgctggtgtgctatacccattaactcgtcatttagcattaggtagatctcctaaagctatccctcccccctccccccaccccacaacagtccccagagtgtgatgttccccttcatgtgtccatgtgttctcattgttcagttcccacctatgagtgagaatatgcggtgtttggttttttgttgttgtgatagtttattgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatatgtgtgcatgtgtctttatagcagcatgatttatagtcctttgggtatatacccagtaatgggatggctgggtcaaatagtatttctagttctagatccctgaggaatcaccacactgacttccacaatgtttgaactcttgtttctttatttttctctagagtcctttctcagagccaagggtgtcttgacaagtaaaagagaaaaaagttactaaacagagagaaagagagagtaacagactaagaaagacagagacaatttcttcaaacctctactccaaaaaatcctcctcaaaatttaaacgacacatttgtttaaaacctcaaaattcttgcattctttcaaaacactgagctgttagattctaccaacagtatccgctctccaagttagttctttaggttcctgtgtgttggatggggaagaggtagggaaaggaggctagctaccttttatgtctgtgaggaagggcaaaggtctggtttggctaattttaaacaacattgtttaaaataacaggaacttgaactttggagacagttgctagattcaaacagcagcacaaacccctcattacttgtgtggtcttgtgcaagtcatttatgttatgaagcttcagattccttgacccacctacttcacacctaggactattaggaggattcagtgtgatgatacatacaaagcatttagtccattgcctggtgtacaataactgcccagcattaactctgacattgtagtgtgcttatgtttacaaatgaatatcaagatgttagcattgttcaaggggcaattaaccaaagtcattcattaaagttgttgagttgtttaataaacaactcaattaacataaagactctttaccaaaactttgaactttgttcaaatttcattcatccaaaagcagttgctgagctctttctagccaccaggcataactctaggtcctgtgcaaaacaggcttttggagcagatggcgtgcattccctgatggaactgaaggccctggccaccattgtggtgaagttcataactgcacttactgcatgttctggctggctacttaagaattccctaaggagatattggatagatcaaggtacttagagcttggtttcaccttctagggggagaaagggttgctcttaacaaaaactaggacaataaatttaaatgtgtttataaataatgatgtaagacaactatgtcaatgttgttaaagttggctgttacttttaagtacaaaattgcatattccttatttggtgggattactgtacatagttatttttagaaatcagaaaagttaattgatttactgtgattctctcgttttacaaaaatgcaaattgttttattatataagaagagtccattttagaccaaattcattcccataaaatgaaaacttcttggaaaaacaacaaaaaagaactttttaagaaaatgtattgattggtaactcatgacatttcttttctgttttgctttttggctcctgtgaatctcagaaaaaaaaagtctgttgctactcaggaggctgaggcagaagaatcgctcgaacctaggaggcggaggttgcagtgagcagaaattgcaccactgcactccagcctgggtgacagagcgagactctgtctcaaaaaaaaaaaaaaaaaaaaaaagtctgttgcttgacaatggctaaccttagtagaggttttgtggtacagttcactgatctttttccttcattattcagctttgttttcttgagttttatattaaatgtttttaaaaatattttggtaattatgcaggttaataaattataaaggatatctatagttttccccatctctttctggcattctaatgacatgaatgcagattccttattgatccatataagaatgagctcccagaagtgagtgtaatggaatcaagtagccagaaatacttagtaattggattgtttttcacattctgcactcaacttttatggaaaaaaaaaactcgaatcaaagtatatcaataagatgataaatccattcattccttttcagtatccagtccagtccatttaccagggagtagccaccaccatctgtgcctcaatattttcaaactaaacaacaattgtagtttctgtgcttaaaatattgatggaattagtgattccccatctccttcgtatacatttcagactctttatctgtcctacaagaccagtgtctcccacccttgctgccttgcttttaattcctcaaacagtgagatcaccatagagcttccggcccataacaggtcagcaaagtcttagtcatttaacaggtccaaacttaaataccacttccttagaaagcctttcttctttcaaccaaaattaagtcggccccctttaatgatacctcttagcacctctgttctccctcctagcactttgtgtacattttaactacatattgctttctatttgtttgatgccagtcttgctccacttgacaatattctcatgcccataatggtgtgactctggctagtttgttcttcattatgcacccatcacctggcacgatgcctggcaagggagtaaaggaggatgggtagatcagtttttcagggaatataaaaatgacagcacagttttatcacaaatgtttaatctttctgtatttccatatttatagcttggagattgcatagtaaacaggaaagaggatgaggttttgaatcaaaattctcatgtttgaatcccagcctggcacttagcacaatcacaaagaactgtaggaggaatgcaatactcacatcatctaattcatggtatggctgcaaggccaaatgagaaaaatggagatgcattcaaaaggtgagagctacatgagaattcatgaacacaaagaagggaaaaacagacacagggcctactcgagggtgaagggtgggaagatggagaggaacagaaaaaataacctttgggtactaagcttattacctgggtgatgaaataatctgtacactaaacccccatgacttcagtttacctacataacaaacctgcacatgtacccctgaacctaaaataaaagttttttaaaaagtaattgaaatgttcgtaactcaaaggataaatgcttgcggggatggataccccattctccattgtgtgactagttcactttgcatatctgtatgaaaacatctaatgtacttcatatatatatatatatatatacacgtatatatatatatatatacacatatatatatatacgtatatatatatatatatatatacacatacctactacctaccctcaaaaattcttagaaatttttttaaagaataaaattagacccctatctctcaccatgtacaaaaataaaatcaaaattggttgaaaacttaagtcgaagacttcaaactatcaagttactacaagaaaacattggggaaaatctataggacataggtctgggcaaagatttcttgagcaatatcccacaagcacaggcaaccaaggcaaacataggcaaatgggatcacataggttaaaaatcttctgtacagcaaaggatgcaatcaacgaagtgaaggaacaccccacagaatggaagaaagtatttgccaactatccctctgacaagggattaatcaccagaatatataacaactctataggaaaaaaactaataatccaatcaaaaaatcagcaaaatatttgaatagacatttctcaaaagaagacatacaaatggcagtcatatgaaaaggtgctcagcatcatcaattatcagagaaatgcaaatcaaaactataatgagatttcatctcaccccagttaaaatggcttatgtccaaaaaacaggcaataaataacaaaagctgtcaaggatgtggagaaagggaacccttgtaccctgctggtaggaatgtaaattagtacaaccactatggagaaccatttggaggtttctcaaaaaactaaaaattgagctaccatatgactcagcaatcccattgctgggcatacacccaaaagaaaggaaatcagtatgttgaagaaatatcttcattcctatgtttgtttcagcactgtttacaatagccaagatttggaagcaacctaagttgcatccatcagcagatggatggataaacaaaatgtggtacatatatacaatggagtactattcagccgtagaaaagaatgagatccagtcatttgcaagaatttggatggaactggagattattacattagatgaaataagcctggcacagaaagacaaatgtggcatgttctcatttatctgtgggatctaaaaatcaaagcaattgaactcatgggtttagagagtagaaggatggttaccagaggctgggaagagtagtggagggttggggagaggaggggatgcttaatgggttaaaaaaatagaatgaatgcataagacctactatttgatagcacaataaggtgattatagtcaataataacttaagcgtatatttttaaataacttaaaaaatgtaattagattgtttgtaactcaaaggataaattcttgaggggatggataccccattctccatgatgtgcttgtttcacattgcatgcctgtatcaaaacatctcatgtgccccaataaatatacctcctatatgccacaaattaaaaaaaaattaaaaaattaagaaaaaaattgttctcaagtgattaaaactaagatggctgggtaatttaagctctgtattgggtataagcagaacatactttttctaaaccttgtgaattttttaagtggttacaaaatattataggatcagactttgtaatttcataaatattattattacaaataatgtatccagagcgatctcaattatgaagtcatcaaggatgggtaagaaaattacagagagaagcaataaatctgaatgtacagtgcttatcttcaagtaacttaaaaggaactatgaacaaatgttcatagttttttgggatacattaaatgacttagtgatacttaagaagatactttgattgatgttactaagaaataataaatgagtaaagcatgattgtagttatggtgtgagtaatgatatgacaggatcatgtgatagacattgggggtaagataaagatcataacaatagcaaacacttatatagtacttatgatgtgtactttattatattatgtatatattatattgtgtaaccacttgatacattaacttatttaatcctcccaaccacactctatgaaatatataccatcttaatctttctttcgttgatgaagaaactggggcacatagagattttggtacttgctcagtaagtagcacaatcaggatttgaacccagataagttggctcttaaccaatacacagatctgcctcttttgtgatttaatcaaaataaactctaaataaagacattacaataaagacattaattagctgctaatcagctaattaagttaaaaatgtaaaaagtgctaattgaacataaaggagagtgacaaaagtgtgaaatgttcaggattatctaatataataaaaagcttatcaaaggtaaaaaagttttcattggaaaagattcatgaacaagcattctagaaattaagaaatggtaaatggccaataagcatgttgtaaatatttcaatcatagtcttttggttttcagtgctatctatagactgacaccttccttatgtatatgctcaggcctaaacacatgaactccagtcccccgtagtcaatggccttctaaaaatatcttaggcaatccagaaccaacaaattttttttcttcctacaccaagtgtccctcccttagaccagaagcttaggagtcaagcatccttctttcattctctacatccctacatctgttccatcaccaaatcctctatgaacaatactttccagactcacgtcaatgaggcttctgccttgggtctgcttcatttgtgcttctcccagtgatctgcaaatctcaactcagataaaacctcatcagagatgccttccctgcctatcgcatctaacatgctaactttgctccactccctccctcatcactctcaatgcccttatattagaaatgcttctttttttctcattaaatgttagtagactttatttttaagagcagctttaggttcacagcaacatcgggcagaaggtgcagagttcccatttatccttgcctccacacgtgtatacccttacccattatcatcctcttccacagagtggacctccactgacatgtttttattacccaaagtccatagtatacactaagattcgctcttggtgttgtacatcctatggctttaggctaatatataatgacatgtacttaccattatagtgtcatatgaagtagcttcactgctctgaaaagcctccgtgttccatctattcattcatacagccctcccccaacccctggcaaactctgatcactttttatcgtctctatagttttgcctttatctttttttgtctttcatctcacccctcttaataaaaaccattttaatttgttcattactatattcccaggttatggaatagtgctaggcatataatagatgacttttaaatagctgctgagttaatgaattattatatatatacacacacatacattatatcagtcatatgtaattatatacaaattatatgacatgtagatatataatatatttaatgatatacttgtattattattatatatgtatatatagatatatataggcattatataaaatactcattttgatggggatactgggaagtggaccactcatatcttagtgatggtagtataaattcaatgttctggaaaacaattagtcaactaatatctgaaatagtagagcattcatcaacgtttacccgataactctaaaaagtgtccctaaagatgcatcattctgtatccatcaatgtcagctttgttaagtgaatgttccacatctataaaaatagtacatgcaattatttgaaaagttatgctaccaaaaatactgactggcatatatagtaaagcaaataaagtttactaaataatatgtaagtattcatcttaatgtttttcttaattatgtgcacatatatttgtatagaaaaaagacaggaaagattatctataataattttaccatggctatctctgggtagtgtaattatggatcattgttttcttcatttgttttataatctttaaagtttatatcataaacatatttgtacttaggaaaatacagatagtacttttaaaagagttctgtttagttctccaagaactaaattttatcatttgtttaataagtatttcatgagcaatactaaactctcaaaatttgttaagtgctctgaagtttacaaagataaataaaaagcatatctgctctcaaatggtttatgttatcattaccttggtttatcatgggacaaagcaataattagacttaaatttaaaatttaatggggttttgggagatgaactatggtcttgaaaacaaaagggacatgtatgaaaccacaggtttctatctactattcattgagacgttgcttagccttttctaaactcagtttttatatctgtgaaataagaacattgagagaaacgaatgataaaatgaatgtactctaaagtagtatttcagatttcatttgataatacctccaagcaattaatctcacttatgttaaaaatatttttcacatttttttgtaatttatttgtaaatagaaaatatgttcgggattctaacaattgttgggataatgacagaaataattttctctgcagatctttcccccatcaactcatccatctttcccccatcaactcatccatctttccaaccattgattcatccatccattcatccagtttttataggatctttcctagacaaagcactgtgttgggcaccatggtatctctttaattacttttctcctttaacagtcctttaagactatgtatacattagaaaataattaatctggtatggtcagctatctatatgaccattttgagtcagctacatagctgatatgaatgaacttgatgaactccaatattaagcaggccaaaattaagatgctcagtgaagtttcagcagcatcacttgaagaaaggaaagtcagtgccttcctgtgttgggctgtggcccaaacacacaaggagtgtaagtttaaaaggcattctcaaactggaacacatccaaatcagttaacaaggctagaagatggttgagaaaacatactatatggaaactagttggagagaacagagatgtttaacctgaaatggggaaatttagtggaaaggaaggcaaatgcttaaaaatacctgaggttctagcccacgaatggtaccagaggcttgctctcagggattagaggtaaggttctaaggagttcagtgttgttagcatgaccaaccatatgcactttttgcccaagatagtcccagtttatgcctgctgcatgcagctcagttcactcctattaattacttagagtgccccatttcactcagaatgtctcaatgtgaacaaaaggttatatttgccctaagttttgtagaacccatacaattctttgttctacatcagaaagagctttccaatgataaagactattcaataatgtgatgggacaacttgccaagtgactattttcctgtcactggtaaggcacaagcagagacctggggtcacctgtctgggatgttctaggtaaggattccttatttggtgagaggataaagttggtgacttttaagttttctgccttctgattttaagattctgttgttttgtttttgaatattctatggtcaaatatcagttccatgacatacctacgaaaacacaatttttaaaatatactctttctctcgctaacatgaagacttctccattttacatttcattgaatttctgtggatgttgactaattctggagatgtggcaaattcatactagtagttctgtgtgtgataccttgtggaatgatgggaatccctgctatgataaagaaataagaccgggaggtactgtttaagaatatgacctggacagaaaataaatccaacatttattgaaatttgtttatttaatattgtaaatggtttgcttttatatagatttaatatatttaatagttattctatattataaatcattcactatagcaggctgtttcagggtgtaaaattaagagcgcactgcctttgaacttaaacggcccatgttagaatcctcagtgtgccagttacatcagttctgcgatttgaaatgaaatatttaacttctctctgagcctcaccttattccgtatatcctacaaagagaaaacactacaattttggagtgtaattctgaggattagaaataattatgttaaataaccttgtacacagtatgctttcaaaaagttcgctctggtgaaagactgttttgtgaacatgaaatctattttaacctacttgtcactatttaatgctgctctgtttgtgcatccttgtgttcaaggttgactgtccatttgttagcacatctgcatattcctcataattaatatctttttaaatgacatatggtttagtgactggaaatcgagtcttgccttctgttttcaatttgttcatgactcaatgactcaatatatgtgtctgaactttaattttccattctggaaagtagaatttaaaacccttgctcatatgtagctatttcggaaaatgatgaagaaatgtgtaatccaaggattttgaatatgtgccaggctattcagcgatgcagcatataggtaaaaggccgcagtttctctaatgttaacagagaagcctaaatgagaatgccaaaaatgtaatccctgaagtgaggggataatttggggtaggctagagtcagattcctagtgaattagcaagaagcaccacatctaaatggaatgagcacaggaagagttggtgggagccctagggaatgaggctgagaacatcattaacctggatgaacaactgatagtacccccagggcagtgcttctgcaagccagggatctctgaaagacaaggcccagtgcacccctggaagtgagtttctaacttccgagtcccccgtagcatttatacctcttttgtgctgagtactctttttttggtgatacagttatttgagtcaggtctaatctgttaaacataaagtagattatttgattccgccttctacctattctgccctttccctgcctctaacaagaaccttgtgcagagtggtattcagtgtcttgtattatagaattgaatttgatacaaaatattacaggcttatttgatattttaatgcagcattttatttcactattttgaaatgcacacacacaggcaaaaaacaaaacacacctcaaaagtaacatgttggtgggatgtcctgagaaagaattcagtgcatatggaaagcacagtgaattcattttctccctaaaatattcttcttcttgtccccacagacttggtagccaccaactacgtttgtaaagcctctgtttttgcctttgagagctcactcccagagttttataaatctgcagggagcaaaggtttaggacatgtgtaaataaatcattttatattttttcgtttgttttattttgttttgttttcttagagaagtttaggacatgtataagtcattgtctatttggtgttttgttttcttttgtttttcatatagatgagagtccagtggcgtatatcatttttaaagtttaataaaattatacattcaaaagattataccatctcaattattccaatctgtgatttaatttattgcttaatgttttgtatgaatttgattttctgaagcaggttaaatttgaaattttattaaaaacccacttcctttgagtttatagattgggatagctgttttatctagtcgctgtgtagaattagtatttactggacaagatgtgttgattcaggaggttgtcttggagtgtttgccccgtgagggtcatattaaacttgagagaagttctttgagcaacagagcatcttggagacaatatatcaagctgatggatacagggctcttctgttaagaaaccagcagtggaattatggctggctcccagttattgctttggtgctaaggagcctctaaggattaaatctaggataaaaggggttaaacagaggggaaaggaaggtttccagaattcagtgttactggaagcatacagaatgagtagttatatacaaataatttaagatgaccattctgtttggaaatatttcacaatttaatatattcaaagtgtaccaatttagtggagcatattgttttgttattactcagaagagaattcgtgacatcttattattattataaagcctactttggggcacttcttcctactgtcttaatagaaaggtaatgtagtttttaacacataaggggttttgtgtgcatattaaaaactaattttttcagggctaatgacttgaaattcagaatttggattttcaattacattatactccttgatgtagaaaaattagacaaaaataatcaaaagagagacatggttttatatgttatacattgtatgcattttgcactttattttttgcctgtgttttcacagtgctcttttttctatgtatgcacttattataaatcaattaaagtatatatgtcaaataaattatgattgttaaaaaccatttgtgttcatagataaaaatatcaattaaaaagcctttagcaatgaatgtccttcaaaccaaaaatgtgaaggtaagaagtggatagttggccctggacagcaatcttcttgcactttctagtcatgccacacttttactaattgagagaattatttcatatcatttcctctttcttcaagcctccatttcatccacccaatttgtcactgagcctttgcttttattttgctcactaagaaactgcgcatcatcaaaggagatctttgctattattccatcactgaatctactcactgctctacatcttcatctgtgcattcacttttgcacaatgggagaactatccctgctctgtttggcagccagtgtgcactgactctcagttgattcaaatgtgcactggctcacctctctcttcccacactaggactttgctctggcaattctttcttttacggtatcatttcccctaatctgtgttagattcttccaacaaacatgcctatatgctgcaacatcttccagtctttagaaaaccttcctttgatatcatgagcttttctagctgctgccccattttctaatcccttttagaataaattccctctaagtgttgtctaagctcactgtatctgccctttaccccctcgttgtcttcacaaccttagctcagactgctatgcccagcactgcactgcatctgctctttgcaaagttatcaaatatctgcacttggccaaatgcaaagtttcaactcccagtcttcttcctccttaaactctcagccgagttgatacagctgatacgttcttcctttttcatgtgccttctttctttactcggcttccagtctgcaccttctcagtttttctcctacctcactgaccattccttctcagtatcctttcctagagaggcctcctcctgacctcaacattttggtggattccagggcttggttctcagacctcttctatactcattctatcaacactcacttcctagtttatttcaccatctcagcctttaaagatcacatatatgctgacctacaactcctatgaaggctacaactcctatgaagacttttcctctccctctcctccttagtccgtgttagccacactgttccttaaacacaaccagaatgttttcctccttactgcctttgaatgtactgctatctctggctggattactcttcctccagacattcggatggctacctccctcatgccagtgaagtctctgttcaaatatcactgaattgcattttcttcctataatcttcccatcgaattgaagttgttacctagtaactaaaactgcccaattctttttaccttctctttccttacactgctttatttttctacaaagcacttatggccacctggtattattgtatacacagtattcatttgtttaccacctgctccctccacttgaatgtaagctacctaggggcaggagtggtgtctattttattcagtgctgttcttcttccacatgaagagtactgcttagcacagagtggagccttaataaatgtttattgaacaaatgaatgaattattaatgaactcaaacccattacagcagattgatgaaacatgtaatctaattcttctgttctcatcactggtcattcattagcctcattgttcacagacagcttcttctgaattggagagtatgtaaaattgacacactacacaaggttatgtataaaataaagttgaaaatggaccctgatatttcatttgttctcattattttgatcacttctccttcttcaccaatggcctctggtaatttgtggtcattaggaacctatattacaataatcagaatgttcccaacaaagtatattatactagcaattaaattatgctaaagaaagttcaggtcagtccaatgtaataatagtaataatagttagtgactaataattaccagggtctaaaatcaggtgctttatttatatgatctctgaacttcacaacaattctataaaggaaaaatattatacctactttagagatcagaaaatataggctcggagtcattaggtcattttcctaaaggcagagttttgctgaatttgctttcaagtttctgaatagctttggaacaaactgatatgatttggaacaagctgatatgacaggctcatttgagttataccagttggaaaaaattaattaaataaccagagtcatcttatcaactttttttagtagaataggctttagttttacacattcctgttaggccttctagaaccattcaaagagatttccctggtagattgtaccaagcaggtatgttgaagtcagaacagatttgccggagactcaactagactagaaaaagtggtatgcatgttccaacttgcaaaattgagtaagggcaggagaagggataactctgagaagggtaattgtataaaacacatagggaaaaaagtttactttttatattttcatgggtgagcattaaggctggaatacactgtattcagccattcatgtttatttatcattccagaaaaatacaattttagctaacttcccttcctccaaaaaaaaaaagaaaggaaaagaaagccattgtgttcacatgtagtggtgtgattaaggcagcaatggatgatatcggggggaagaatatgagatctggactgcttcagtgttcaattgtttggtctgttgaacaaagagttaaatgaaaaaggtactttaatatttgcttcactaaattccctccatgttttcaattagataaacagaagtacaggtgggaatgtgctgcatattcatttgtcttgctgtttgggggccggcttttaagactgaaatactaatgtaattgtgttgaaatgaacaataaggaagtacaggagttcaggaatgaaaatgttaaattaaatggaccatgtttaacattgttgttgatcctgaggaacagtttttccagtatatggagcatttcgattccatccagcatatgttctccacagttttctctgctctaattcatctgtgtttttcgacagctccagatggcgtgctgcctcccaggctttcatctgccactccaaccagtcttcaggttgtctggtctacaccagctcgtaataacgctcctggctctcccagataccaactccagatgaggtctggcgactccacccatggatttctagagtgagcattctactttgtccattctatcagctgggttatacaatatagacataacatttttgaagagtaggtcagttctcatttgcaaaaaatataggttaccttttaaaagtacaaaaaaaccccaaacaattagaggataatcatttgctttgcaaaaatatctatttttcatttatgtagcatttaaagtaggatttcttcccactgaaacttttcatgagcacatgcattacataaagcaatgaaactaacaaaatgatgtctgaactgtcgctaacaaattataatacctattctacaaatccacatggcagtcagtctcaatactactaggatttacatctcgtataaacacaagattacagactcagccaatggctacttattttaaaagagatctcatttgatggcagaaaattacaatacttaaatgtatgttgacatcctctaaaatttttttgtagtaagaaatttacttgcttttatttctttgaatgtcgaaaacttcctaattgacatttatttcccatacaggttattttccaatccttctgcatcgttaagctatgaagtgagtgatctccaaccgtacacagagtatatgtttcggttggttgcctccaatggatttggcagtgcacatagttcttggattccattcatgaccgcagaggacagtaagtggtctgaacaatacacagccaaatgtcttctacatagggagcttaaaatgtcttcaattttttccaaagcaaagaaatgagcctcccttatttacttgttgtttagtgacaataaccttttctagggcaagagagtgagcaaaggtggtcagtctctccagaaagaagaataatgtggtcttggagggttggagggttaggcctacagacaggacaaagtaattcactataaattatgatatggccccattctatccttcagggtacatcttagcgccctgcaagagaaaggttgtcatcttctgctttatgactgaatgttctctgtttcggagaaattctggcaggcagaagaaaatgaaatatggaccttacttcatgaggctgcttacatatacttgttcctggaaacaggtttcattttcctgcttctactcataccccaaagacagccttcagcatagagaagtataatctgatagcagtatattacaaaaggtggattaagatttctttattcaaccaataaagagaattttctagttgttcactaaaaagttatttttgcatatatttgctagattatatttgggaataaatacatgactataacatttggttttatacaaattacctctataaaagcatatatatgaaagtagaggggtttttaaagaaaagttagaaattaaatcaagctacacagagtgaataaggacattgtatctttgaacagttaggttttttgagttaatcttgtgaagtcttttaatcataggcttcttaggcaatgttctctgctggcccattgccatgctggctctatatccaatgagaacgttaagtgactttcaaaagcctagatattaacacaaaagtatggtatttgcaacaatatcaattgtttattaaatgtattgttttatttctataatacctttaattgcattattttagtgaagataagacatcaaattagacattatcagtacaatctatcttgtttaaagttgactttatttttacaaaaaaaagccacctttatgagcaataatgtatgttacttaattcatttcttccaattcgtaattactccctgggagaaagttagctactttgcaaggggacactcagtgtttttgttctcaagggtatcatttagtaaattatcagcacagtacgataaatggcacccaaagtccagaaagcattaattcaccaccttttaggaggaacattacatacactctggggaatctggacaccatgatcaccagatttatggactgaagacttcacactcaaaatagatttttgaagaaacatttgaaacaactgaagatagatttgtaatctccttcttatatatagcagcatgcttgatggcactaaataaagattagccaaaaataattattcaacccactgcagaggtgatggctcaatagaatgcttggaagaagggagaaagcattttttttttggcacagcattctttattctcctagagaaagggcaacactcaaacttcctcagcggtaatctccccacaattttcactgaatgagggccatgacctgccatctataggcagggaggtagcacataaataagcaaaagtccaaaatattgtaaaataccaattagcatagcatcctttgttgagcaaacttacctttggtctcctttttactataaaacaagccttatagaccacacatacacatcgttagaattttcatacccagagaccctccattgttgtggtatttagggcttgagtttaaagtgagtggtattaacccttcattttccttaagtaagaattagtaacacttgaataaatagcaggtatcaactcataaccattatttgtgtttaaatccgttccccaaaatgaatgaactcttccttcctctgctttgtgtatacactgtgaagtcacatacatagcaaagaactggaaggaggccatgtgtacctgcaggttacgttagcagtgcacctgagacatggtgacagggtactgtatattttagatgtcagtggagatggatgccatctctgaaaggatatgcaattgagttgacaaagactgagtgattggcattgggcacaagcagtttttctgtcaaggctacaaagcattgcttataaaaccacccatgttgacagctccatgccagaatcacacttcttacttgatcctgaccagcacctcctgctcaccaaagtgcaattttctttctctttctttcttctttctttgtttctttctttcccctctctctctttcactttctttctttctcactctctttctctttctctctctttctttctttctctttctttcttttcttcctttccttcattttttgagacagcgtttcactctatcgcccaggctggagtgcagtggcaccatgtcagctcactgcaacctctgtctcctgggttcaagcaattcttctgccttagcctcccaagtagctgggattacagatgcccaccaccacacccagctaatttttttaatatttttattagagatgggtttcaccatgttggccaggctggtctcgaactcctgacctcaggtgatccagccgcctcagcctcccaaagtgctgggattactggtgtgagccacctcacccaacccaaagtgcaattttcaatgtagaaatttcacatatcgtcttacagaacgaaacagagaagtcgcctcgtgcccacatttaaattccataccatcaacaggcacctttctgcatcagccacagcctcacagctttccagtgccaaaatgggtcaccaatggcaatatttttagtgtgacatttcaagacagtgattttcagcaagcctgtgacacaggtgaaaccacaaagagaaatctaggcaggcaatgagctacagccagagaagcaaatgcatgggtgcagagaagttatcatggacagggaaacaggatgtgaagaattttaatagatttttttttcaaataatttgtcatttacaccagtgtgccaccaatatccagttccatgcatttttaaaaatctagtgtgctgatgccaaataatcataatgcacatttcctatgaatattttaaatcctgttaaatgtgtgttaataaaagatgtttgttccagccaatttggtcagtgtagtgtttaactggttgcaaccagataaatacaaacaacacattattttttaaatgtgctgctggcagtccaagcacctggcatgtccacagcttgcaaaaatgtcctaagattatgttaggcttgggagcatgtgattaataaaatgaaggcacttgcctagcagctgaaaatgttgatatcttgaaaacaaagataaccatcactcctgattatatgattgttccttctctctcgtatgtttgcaattgttttctgtatagtacatgcatgtagaaattagagttggcagggagggcaagtttttcaaacctcagcttaaatgtggatgtattcttttgcctaccgaaatcctgccttgtgttaactatgaattaacctactttttcttaaaattgtggattccccagcccaaaaaagttagataatctgtttctcttaagatttcccaggaaataagattgaaatatggaatatctaatttcagtcattttaatgacaaacatatatggcatacacaagcaattagatcaactaatgaaattgaaatcattttctaaaaatcacttccctaccctcaaaaaaaaaaaccccaaacttgaattcactttagattttaacaatttagttgtcatatatttaaaaatgtttgatcgtttcccaaatttgtagtttaaaattccatatttatatttttaaccactagtctaagaggcactactgcataaaacctgtagaattcgaacagtttattctgtaggtttacttagacaacttttcatttgttcattattttgatgacacagtgatattttaagtacagttatatgctgcacaacatttcagttgatgatgaaccacatatatgacggtggacccataagatgatgatatcatatttttactgtaccttttctgtgttgagatacacacttatcattgtgtgacaaatgcctacagtattcagtacagtaacatgctgtacaggtttgtagcctaggagcaacaggctataccacacaaactagctgtgtagtgggctataccatctaggtttgtgtaagaacactctaggatgtttgtacaacaatgaaatcgcctaatggtgcatctgtcagaatgtattcctgtcattaggtgacacaagactgtaccattgccatgctatatttgctcattgcattacatcttgttattttttcacatttataattgcactgtgaacagaggagagggcaatgaaggaaattgtcttactgcctgggtcctgctttacttttcccctcagcaaccttcatccatccttcagatactcacagtaatttacaaaggaacagaggttcttctggagtaagacagaaaggcaatgtgaggtcaattgaaatctagatctaacagaacatgcttcttcctcttttgttgcctgacataattctacacattcatcaagccccagctcaagtgtcacttcctctgtgaagttttccttcttgttgctcccttagaattttggtttgtgtttactagtgaatcatcaatatccccttctgaattgtaacgtctcaagacctagggatctgtctcaactatctttctatcaccagtgtctggcgaagggtctgatatagagtaggtgccccaaaattcttactcaaagtactgattaaaagcagagtttgattgaagtaaatccacaaaaactcaatcaagcaaacatttaccgtgtacctactgtgtaccagggactaaaagagatatgaaagttgcaaggatggatatgatactgtttttcccttgagatttcctctgtctggcaaggagcacacacagtaaaaccatagttagagtgaaagagctgagttgtccatgagagcaagctcagaggaagggcatggcccctcaacatgagggccaggaaagcctacccagagaagaccaggagaggaattggaaatgatttatatttggagtgcactttaatatcaaagttcaaatttacaccatctccacttgttcagggtaaggctggaaagcaattgctgtaagagagcactgacatatgagacctgaagagggactctcaggttgtcctgtcggtcgttccagcctctgagtatgaggcgaggagggtggggacaagaggtgaatgtaagagagggacatcccaaaagtgattctcatttttttaccttggtcagaggcaggcttctggctgtccctctgattcaatattggctgctgtcttggctaggttaacgaatgttctagttagagaggcttctgccagccccaaatcatgtgctattcggaatgaaggggagggatgtgtagaaagaattctaaaacaaaaccatttttcctgtttttattctcacaacctgtaataagagtaaaatactctgagaccgtgtaacagaagaggaaggaaacatgtggtataaaatttgataaattgatcaagataattctagagtaggacttccgaatcatttaagtgcacatatgcccttaagattactgaaattttaaaactaatattgcatgacaaacatcttatgtttagggcattttagaatttaaagtttcacttgcatccttaaaatcattctacgcaacacaaggaaaatcggaatatttttaaatgagagtggaacatatttatatgagtacattttatttaatgaagaaagaggaactacaagtttcagtagtgctacacaactattttgctttctccattccaaatatttttccagttgccttaagtactaacctctgattgctgacatgtttttcctttcaaacagtaattcaggtatctattttgcatagaacagaagacccatgatcaaaaataacatttataatcttctgattttgagagcaaaatggttctgcatgttttcactacatactttgttttctgttgcatagattttctccacaaattcctgaattttcagaattaacaaattcaaatatttacaattatttttatattttatttttataatgtaagatcaaaaggaacttattcaagccaaaaatgaccaatacggaatcctttgaaaggatggattgattaatcaaaaattctatccaccttgcctcaatttcccacttaagctctcgaatctcccctgggcacttaaagcacactcctcttccaaatatagagtgcttgtaatgtctgtgtttcttacagctgaagactgcaggtgaaagtaatgaaaaatcaagttttttatgtttactttaagaaattaatgaaaaataattttatcatagctgccttattatcactacttaaattttattgagggtgtattatatgcaagacactttagcaggaaaagtatatcctctcattatccagaaatgctatctgctggccttccactatttttaaaaactattcttgttctttagctttgaaaaagttaaattgtcaatatttgaaaactctcagtggactatgtgagatcattcaaagataattgccacaggttgatatttaatggcatgagtttagttttaattctcaaatcttaaattcttagagagtcaagtatctaaaaactgctggttattaacaaaaagatggatgtttaccataatcattttctatagcattttctatagcacctgcctataaaagaacattctgcaatgctaaaacaatacatagattcatttaatcttgttgtcttcctcattttgataatgtacctgtaaacagagttgatttgctatatttggaataattcagataagttttgcccaaatataaggagtgaatgtgatgacctttaggttttttaggatgttttcctgacttcatgaattctcacatcaatgcattttattttctgcaccaaattatcgcagatgcatctactacgattcaccccacaatatgccccagctctagaggttgaaacattctttctaaacaatactctcctgatatcaggagaaatagagaaaaatagttcccgaatattggttctcctatttgcaaactatcaaataatgtccttccaattccaacagccttttagccttcagaggtttctttcattaaataatgttacttatgttatacagcccatttccttttttatcagagtcaggctgaaagttcatttttctgcaaaactgcagtgcccattcttaatttttgttttgagaaataactgttgtaccctctttattatcacaagattaataatatttctttattttattgctcctcttacatttggatcttttattatgagctgtcaaaaattcttttgggaagtagttggggtataaataataaatcgataaaagaattcatgattaaagacaagatagaatccattattctgttaacatatcagtagtgaataacaaaaggctacattgacaattagcatgcaatatattgctttatataattatacatccatatatttgccactttgatttttaattcactggtaaatttaggggatactcatttatggagttaatattaccaaaaagagtttttaaactgagcgaggctttaattagaatggtaaaatattgcttcagggcaacaatgagaatgtaacaagaaaactgactgatcagtcatgggtaactcgaatagcaaacaagtagagaagactcacaaaaccactgaaagttatatacacactcaagttgtgagtcattcaaactgggtattcatacacatgtatacaaatacaaacaagtgtgtgcgcacacaccctttccaatatacacacctgaatataaaactaaataagcagattcctctgttaacaattttattactctattttaggctggggctgaacttttgaagctgatgagcaaaatagtttcccataaaagataatttcatttgccaaaatgaaactactttccgttattaatgttgcaatgaaatggtttgaaatatgagtctgtgatctggacagaaaggatgctcctgttcccagctccaagagggagttctctaaacaattacacccacggagagcgctgtaaggttgtattttcatcaccggccagctgagctgtgtgcctgtcatactcccagtctcccctccagtgacagccgcattgacaacatgttatactccacattgattttacagttaaggagctgattgtgatatatagagattttaagaattcagctgagaggctgacttttgccttttatcattccattaaaattttataaccatctttttcatgtcatttcatccatgaattcttactttagaaagtgatagctactgctgtgagcataacttttctcatgttcagagctttttattgtattagcaaactaccccaattatagttattactcatgttttacataattgtggtggccctttcaaccatgcagttgcaggccagttgatttgtatatagaattagatgattcggcttatcattttaaagcactaaattgaaagagtgccaggagtcaggttttaacacttccctagccaaaggagctaattaagctgctttcagcttcctctccagaatcacacaagttaaaggacccttctgcaacaagagcagcgaatctactcagccagagcaggaagctaataaaatgtatgctggcttttaagggggaaacaaatcatgaaattgaaattgaacacctctcctttcccaagataagagatcatctttaagaaaaggctgtgtattgtgggggtttgaagtgcaagttcatctcattatcatggatgtttcacccataatactatcatcatatgcaggagaaataaaagccttatcccccaatcacagagaacaaactgcatcattgttgtttcttttccctgaagatgctcacagtttgatagttcacatatgaggaataattatgcaagacccagatgaaaaccctaataaaaaatattctgatttttaagtgtatattactctctttggggaagagagggtgagataaggttagacattaaagacttgaatctccaccattgattttacgaaacccaatctcaggggatttgggggtttttttagatttcaaaacaacattgatatcttacaagactcgtacttgcttttctctgggaaatagccaaatctagatgacaagcataaataagaaaggagctgtatccccattttgatataataattgctactgctactgtataccagagagcaaaagtaagaaatggcatagtggttttaagaaagctttaaaatgaaagctaacaagagactgaaacggaaagtgtgatttataccatgactgctggttttagggttttttttagggatttctcttcaaataggatacattaccaaattgtcagaaatagcttgatttcagagttagtgcactataacatcttttgcttcgaaaagtgattatgattctaccatcagtccagttggtgacaaatacgtggatcctgttgtgtgaaagtgtactcatataaccaactattattgcagtcactggccctgcaaagcagtggttgcatttaaaatttcaaccttctttgtaacactgaatcgcatacacacactcacaagatcaacgctgttttaaacaattactaaatccaagtatatcttttttaaagattttcaataaaatctaatgttcacagaaaaatctcataaatgtcaaaattgctgtgggcagaaaaggggggatacagtattttcttgatctgttttagcaatttatagatttcaggccgtggtttataagaatgctaaatgttctggaattacagctgttactgatcagtgattgagccagatttgtgttattgcaccatgttcttgcttgtacctagagagcagtaaagcctcaatataataaaaagcacctgcattttaaatgaaatttcaattgaaaaacttaacagcccttcaaattgcagaatttaacgcagcccagtaaagcttaaataacactttgcccccgcaggctgaggggtttgcattcaaggtgacttgattgtgtcgcatggtgaaattatttacaattaaggaatttctctggagggctgcagaatatttgctgttccacaacacctatgcaggcatatggtgggcctttttcagtattcatggagcctcctgaacctttatgataattgaatcagttagagtgctgagtggagcaagcataaaacctgttaacctaaaggtcagatctgtgcattgtttatttatcagtaggtgaaagagctaaatcggcagcttctgtcacagccacagtaaaaaatcgcctataatattaacagggagtagataaattgcaaaacatggattagaatgataaacagaaccaagtataatatagaatatataatgagagatgctgaaggattttactgggctgtaaaatatgcaagtttgttatgatagtgttattgattataattagttactggggctctagaaaaaaatgtaggggaagctagaactttagtaacaactaccctcttgtatgtttattaaatttatttttttaaatcctcattttttaaccaatggcttgaataaaaagacatgattttgataaagctgtcttagagaggaaaatgatcattttagtttcataatattcaacaagtatttcacacgcaaaatttatgagcaaagcaatcacagtccttgtctttatggcacttatttatttacttattggcctttaccaagtgttcattttcatatccttgtagcagagctatcactcattttagctttgaggagaggtgggacatttccaagaggtctgactttctggatttattttactttacagaacctggacctgtagttcctccgattcttctggatgtgaagtcaagaatgatgttggtcacctggcagcatcctagaaaatccaatggggttattacccattataacatttatctacatggccgtctatacttgagaactcctggaaatgtcactaattgcacagtgatgcatttacacccatacactgcctataagtttcaggtagaagcctgcacttcaaaaggatgttccctttcaccagagtcccagactgtatggacactcccaggggcaccggaagggatcccaagtccagagctgttctctgatactccaacatctgtgattatatcttggcaaccccctacccaccccaatggcttggtggagaatttcacaattgagagaagagtcaaaggaaaggaagaagttactaccctggtgactctcccgaggagtcattccatgaggtttattgacaagacttctgctcttagcccatggacaaaatatgaatatcgggtactgatgagcactcttcatggaggcacaaacagcagtgcttgggtagaagttaccacaagaccctcacgacctgctggggtgcagccacctgtggtgacagtgctggaacccgatgcagtccaggtaagatactgactattctctctcctttgcagacttaggaatgtaccctggattgactctgtgttgaacagagccatctactgactaaacaaacgcatttgttgttttaggcattcactggagaaactgggttttggcctttggcccaaactatcttaaattcgatgtcagtttttcatttatccctgtatccccttaattatattgttgagatgcttccatttgcctcgcacacctgaaatattttgaatgccacaatgatgcttagcttaaccaccacgtcagatttaaatagatcagaaaatgagaagagatgggaaaataaggaggaatgaattagcatattaacaaaattttccattaccaatagtctggtattttttaataatcaaagaatcaaagtaatggggaaagaaataaaaatagcatattaacgggctatccagaaagtgttcaattattcacctcattctattgggaatgaactctagtggacaggataactaccattgttttggctggcatacaaacttcattcaagggaaattagtgtaaccaaacaggagggagttttgtagcttagaagcctcttttgtgtaaatacacacaggcttccatggattcagtcttgtactactgccaaaagcattggtacagtagcttgctcaccggagcacaaaacaaaggacatttgcataacagcaaagttcatctgctgaaattattacttggatctatgttgtgtgttctctctcccccaccaaaagcaaacactaggtgatgctaaacagtgtaaattgttggagaaatttaatttaacctacaaattaaaagctatttttaaaagtctttgttagttttaatatgaagctggtcaaagcaacacacatttttgatataaatatgtgtatagaattccattcattaaacactaatgggaaattaattttaagtacacgatatacgatgtttattgtatgaactgagcaatgtaaagaattgctcttgattcaaaataaaaacaaaaccaaaaacaaaacccaagcatagagttaataatcattccagaaatgactttttttttcaatcttgggggagttttgtaaaactttggtagcagtaccaatcactatgatgcaacaaaacaaacacagtctctttacaaaggcaacactacataatggacattgttctggattatttcgaataaaaatcttataactaggcgttactgattgtggccgatctgaaaaagagtaagtattttcaggccgggtgcggtggctcacgcctgtaatcccagtactttgggaggccgaggcaggcagatcatgaggtcaggagatcgagaccatcctggccaacacagtgaaaccccgtctctactaaaaatacaaaaaattagccaggcttggtggcgggcacctatagtcccagctactcgggaggctgaggcaggagaatggcgtgaacctgggaggcggagcttgcagtgagccgagattatgccactgcactccagcctgggcgacagagcgagactccatctcaaaagaaaaaaaaaataagtattttcagaggaggaactcagtgtacaattctgcttgattcagcatatataaacaataattaaaagtatcagcttgcctggctttttcttcacatttttaccctcttttgattttgtaatatcatccatgaattaaacaatatacatggcttgtcagcctgctagagaagtttagattagcgtggctagaaagctgaatctcataggcactcacctgaggccacaaggcattggtaaccccaagtcaggaatctcaatgtctctaagaaggtgtctgaaatatatgaacatggtacactagtaatattctaaaaattcacactttttattctcatcttataactaggaaataaaaagttatcaatagaatcagcaggaatattcaactgagtctagtatttaatgctatatactatttaaagagtattaagataacatatctgtccttcagtattattggctcacatgttcagaacgatcttaagactttaccgaagtggacgttctcgtgatatagcttagctggtaaacagaggtatatgacagctaaacaacgacttctctttgtaaaatatgagatttaaaagtccaaattgcaaatagaaaatattttatatgaaataacagaaggatagtcattaatgcattggttaagaaattaattcaactatttatcatagagggttgttccaggtattaggatggatgaaggaaattgacagtaatattaacagcagtaacaataataatttcagttctattgacatttacggaacatcagtacatgagtgaacatctttgtaagtgcctcttttaggcagtagggacacagaagagatcaagatgaagtccctaggctcatggcgattacattttagacagaatgcaaacaaataactatgtaatatacctggaagtaataaggacttgggggagaagaacaaattgagtgtagagaaatatggaatgccagctgatagggtgggggataatacaaggagcagagttggtatttcaccttagtgttactcattttgtgcaatgtggtttttttctccatacaatgccacctgtaagaattacagtccaatagggaaatcaagagagacaacacatacttaggctaactagaaaataaatgcaatgtaacatattagtaagtactaaaagaggtgatatgacttggtataaatatgagccttgagaaaggcaaattggagagcacagcagcatagatgaaataatatgcttaaaatcttatttgattacaagaaaaataaatatataatgtcaaagagttgtgtcacctgaataagtgaaagccatgcacttttatttaatatttaatcacctaagaaaatgtatttcattttataaggttggtaaaaatgctctaccaagacctaaaacagttcaatgaaactatagactaatttcatttatgagtacagattcaaaatttctaaataaaagattaccaaattgaattaagcagtatattaaaagaatgatatacaaggacaaattgatttcattttaaaaatgtaaggatggttcaacatcaaaaaatctatcaacatatgtcttacatcaaccaattaaagtagaaagcccatatggtttttttttatcaatagatgcagaaaaaaaggcatacaattaagaagttatttctaacaaaaagtcaaagtaaaatcagattaggaagaaggtacttaaatgggataaagtcaatgtataaactgctgtactgaagccttgaattgaggattgataagaaataacatgtataaataactaagttgcatgactatgatgcaccaaaaaaaagaaaaaaaaaacttcttttatgataacatcatgagcctgtaaaccttgatgcccctgtccactttttcacaggtgaagcagaataaaatagagtaatcctgcagctgtcagctcctcttatacagtagggtcctcactcagctcagacaggtgaagccaccagccttggcaggtgcgccacaaggaacagtgtcacccagaccacaaacatgtgtagcttccttccctctgctatgtacacttagggtcactcatttatgggtttgataataaagcaaagtaaaagaagttgagtcttaatcatcatcctcattgacttttaaagatgggccaatgtttgatgtctacttaaaataaaccacagacaaaaagtataaaacagaggaaataaaataataatgaaaatatattcactgagttcatgttatgttctagaaattgctttcatttaattcttactacaactgtgtcagatagatgctattgtcattcccattttacagacaggaaaactgagaatgagggattaagtaatctgcataagattacataaggagtaagagttggaattcacacccaggcaatagggttctggagcctatgttcttctctacttctttacactgcaacaaatggaaaaaaagtgcaatcttcctggatggaaggacttaactccataacaagacaatccttccaaagtcaacatataaactgaacatcattcaaatcagaatgccgatgttttttgtttgttttatttcaaactggataaaataattttttattttttattttactttaagttctgggatacatgtacagaacgtgcaggtttcttacataggtatacatgtgccatggtgatttgttgcacctatcaaaccctcatctaggttttaagccctgcatgcattagttatttgtcctaatgctctccctcccgttaccctccaccccttgacaggccccagtgtgtgatgttcccctccctgtgtccatgtgttctcattgttcaactcccacttacgagtgggaacatgtggtgtttggaacatgaggtgtttggttttctgttcctgtgttagtttactgagaatgatggcttcaaggatgaagctggataaaatgattttgaagtataaatagaagactaaatgattgaaaatattatagaaaattgtggaagaataatgaggtggtactttctgtagtatgtaaacttactttaaagccattgagttataataatatggtattggcatgaaaaagacaaatggtcattggaaccaactagagagtttaggtatagataacgagtatttgttgaaatgacttattgtaggtagaatctgcattttatttcattggtaaagaatggtttgctttaaaaaatgataccagcccgaccaactatcaatgtgtacggaaaaaacagatccctttatcatatcatattataaataaattcccataaattaaaaatgttaatgttaaaaaagtaaaaatcttagaaaaaaaggagaatttcatgtaatctaaatgtaggggagcactttctaaagaaaaaaagaaactcagtagcttaaaaaaaaaagatagctatatgtagctagaaacaatctgattgattttctaaggcataaacttcccccccacccaccaaaaaaagttaacatccaaaagatagatctggaaagtacatctgtaacacatactacagacaaatcaatttcaccttaatatgcataggccttctaataatttataatacaagatactttaatagaaaataatttaggtaagaggatatattaggttggtgcaaaagtaattacggtttttaccattaaaaataatgacaaaaaccacaattaatttttcattcatacctcacataaagtcaagggagtgaaaattaattaaagaaacaagtaatattagcaaaaacgaatatcagtaatttcaagagtttgtggaggcacagatcacggataatttcattgtttatgataaagtgaatttccccaactttttaagaaagtagtatatcaataatgattaaaattaaacatgcattttccttttggcatggcaatacttggtaatctttccaatatgaaataaacacaagagcacatattgcatacattttcaaattttatttttagcataaaataatgtcagtaggattaacaaataatttgttttcaaccatgaaaggaatattatgcaaccataaaaaataatagggtgtgtccataatcaattaagtctgaaaagcaagttccagcataagtggtagagaactttttttctgtgaaaagtttttaaaaaataaaagagaaagagagagagacctaggatatgcaggagtatatttgctttgcttgtacgagcatacaaaaagtatggaagaataaacttcagactattaagttttcacctgagtgaaataaaacagagccacaattaatgtttcttgtatttatatatttgtactctttctctgtctgattgaaaaaatacaaatagaatatttgaaattaaaaattaagattaatatttttaaaggaaaggaagacattgtgaaagacaactttatttcaacaaatatttattgcacatcttgttctgtatgaatttttcaggggagtccatcataagaggaattactacactgtacggagtcaaatattcccacatgatctttctttatggtacatttttatcttctattgacaaaatactcttagaattatgcaatcttatgtctacacacgatggcaaggattgtctcatcacattagacatgagggttccgaggcctggagatgttaaatgttttgcctaaagccacaccgctttgagacatttatcatctcttagtccattcttaacccatatatcaatctttataaatgctcttattcatgaagttcttcaaaatagtttgatggagttaaagaagtgaggaagttgcttactatgcttttgggtgttactcttttcaagcctgaagccaatcaactaacctgcatgtctaagtttctgcttaaaatggggaactttgaaggtgccatgattctttttagagagacttttcagggatgtaaaagagctgctgaaagtcaatcgttccttaaacacttaaccggcaatttagccgtcctattttctgaagacttacaataaacagaaaaaatggaaacctgaatcattaagaaccactcaaataaaagaagtcattgtgataggaaagccatctctgaaataaacattttatttccagtgcaaaactataattctatttaaaagttttaatgtaatattattgttttaaagaacacatttcttgcttattcaggccaataacatgttcttttgtctgaatttttagggatgcaacaatatttcataatctttcttatgtacaatggatatacaaaaggtcataggaaattaaacaaactgaaagttttaatctcatatattttgaccacatatacaataataaatgtggtcttaagcatagaaaagaatagaatacaatatttagttaactggctccttaaaattcttggacatgggcagggcgtggtggctcatgcccgtaatcccagtattttgggaggcaaaggcaggtggatcacctgaggtcaggagttcgagaccagcctggccaacatggcagaacccctctctactaaaactacaaaaattagccgggtgtggtagcacacgcgtatactcctagccactcagggggctgaagcaggagaatcgctcgaacccagaaggcagaggttgcagtgggctgaaatcgcaccgctgcactccaggctgggtgacagagtgagacgctgtcttaaaaaaaaagaaaaaacttgaacacattgattaattgattgattgattgattgagatggagtttcactcttgttgcccaggctggagttcaatggtgcaatctctgctcagtgcagcctccgcctccctggttcaagcaactctcctgcctcagcctcccaggtagctgggattacaggcacctgctaccacacccaggtgatttttggtatttttataccttatacaaacattaattcaagatggattaaagacttaaatgttagacctataaccataaaaaccctagaagaaaacctaggcaataccattcaggacataggcatgggcaaggactaagtattaatggtttaaagtgttgccaagctctgacctgaactctcaaagtattctggtctaagaggcaagaaagccgtattcttcagattagtcaggttgaatttagctgtgatagctcttctttttttcatttctgttacaaataccaggaagctctctgagtttgaccttgactcattttccgggtccacagacagcattgcacctccaaaacaaatagcgtcctatatctgtgctacaacctttgctagttttagggtgtttttaaaaatattccccacatccaggcaaatcctctatgtttataaggaacacatctaaaacttctcttcatcccagcctctcttcttagaactctccaaaaagtttttttaagattcacaatgatttcatcccctgtagtataatttggtagatattggcccattgttaattataaattaccaaagtaatcatcaagcaattgtccaactagcatgtggtgagagcccttttgtcaccaattattagtaagaatactctttaaaaaatctcaggtcatagtcttcctggatgaaaccttctccctttgatttaagatagaaaattatggtcagtccttctccattttaatttctatattgctcctctttggtttgcataggggtacaaatgtacatataaatatgtcaccttgtagaaacctgtctcttaaagtttcaaaataactgtatgctagggaaaaaaatataatctaacaaaacatgactctaattactaactgaactccacctctgtgcacatggtactaagtgaatgtagagtttatccctgctatgaagaagcttacaggctgggacatgagatatatatcctggcatttatataaagagcactagaaggtaccaataaaagagatgaaagaggataacatgtaaataaatgatttttgtcatggcctgtgcacattttttaggatctctttccccataagaacatgagtgtgttaccactatgctcctgtagagtttagccagaaaagaaaataaacttcagacattctagaattctactacaaaatgttgttctttcttctgatgctcaagtccacatgttagctaagcacaaacatctttggcttccctttttcaaagctttctatacattccttatccctgagaagaggatgtgctattaatgctttaattgctaagttatatataaataagattcaggaactcaattttgcatcttcggaaaatatgaataatgatttctctttcccttcctccaagaaaaagtgacttatttggcagtcacactaacagtgcaaagaaatgagttctgatgtttcatttagttgagttataaacatgaaaaccatcaaatcctatgcaaccctattgaagcatgtggatgtgtgaattttctccatgtgtttgctctgtgtccttcagaacacccacagtggcgatgaatcgctaaggtgtgtatcagtctgacagtcgtagaaagtggcaagactgaaagccaaacccaggaaacagcatttcatttagctcctggagtactgctaattgatctcaaacccttcattactgtctagtccaaaggcctcaggagaatgtagccatttagaaaatgacttaactgaaaacaagagcaaaattctaggcctcgtgaacttcaattgctctattcctgtatcgtcacactgattctaagtttatctttcatttcaggtcacttggaaacccccactcatccagaacggagacatacttagctatgagattcacatgcctgaccctcacatcactttaaccaatgtgacttccgcagtgttaagtcaaaaagttactcatctgattcctttcactaattattctgtcaccattgttgcttgctcagggggtaatgggtaccttggagggtgcacagagagtttacctacctatgttaccactcaccccaccgtacctcagaatgttggcccattgtctgtgattccactaagtgaatcatatgttgtgatttcttggcaaccaccatccaagccaaatggacctaatttgaggtaagagaaggtgactatgatttttatgttgctgtagtccttatctctctgagaagtagggaaatgaaggaggcttttattcctatatgaacatagaactaatttggcattgaatatcccctgactcataactttcatacactatcatactgtacacttcaacttattatggaaacatcaaagtttatcaatttgaagaactaaaaacccttgaaaccacaatcactattgtctaaggattcgctacataatccatcacttcattttcaacatatgcttttattatatgttaggcaaacctgatgtaggttctatatgatacatttgcacaaatgtacctcagaattctaaggctaacacagtaattctttggcatgttgttagcttatggaaacttgtgaggagtgtggtcagggagcccgatacgatgaaagaaaagagctgtgattcagaaatggttttgcaaccacccaaacttgatacttggccaagaatacaaagttgataatattatcatcgtttataaagtattgatagtcataggaaaccattaacttgataagctttgtgtatttctactttgtgcgaaactggcagtaaagatttggcacatctaacttagaagaaatctaaaatgctatcattctgggagataatagtaaaatgcgaatgtaactgattcttcaaaatattaaatatatggaatttggtccagaaaaaaaaacgttcatctgaaacaaaaccacgtaactgtaaacttaagatgttattctttatgcttccacgcatatatcacacgcacatgccacagaacagcctgagttttggtaatctcaatatgagttgagataatcctgatgttcctgcttgtcttttgctttagatatgagcttctgagacgtaaaatccagcagccacttgcatcaaatcccccagaagatttaaatcggtggcacaatatttattcaggaactcagtggctttatgaagataagggtcttagcaggtgagattacaaaaactataaaaacaaatgctggcatttagttctgggcatgttgaatagttcaaagtatctcagtgtcttcattgtgtgagcgtgttatcagttatgcaataaaacatgtttggttattatctgtggcattaatcacccagctgtaacagtcagcatgtttaatgttttccatcttaactgcatgcttaaaataagccttttgaagttgaacttgtagatgttcaagccttaacctattgcctttgtcacggctccatctagacataaaacgttatggaagaatttggaaatattgaacacatacaaaatggggaaaattcctgggcacttgtagaatgcttgctatttctagaaatggcttataaatgaattataatgacttataattgattgtaagttattgattcagtccgcaaaagaaaacattagtgaacaggattgggacttgaaagaattcaatctagagttcaaagacattcagtaaaggctaataggtgacagtagaaaagggtgctacatgggagagttaggagatctggttctgctttagcctgtgctggagaactagctttgtgactttaggccacaaagcttcactacttaaaaatcacttaacttctctgggcttcatttttgttgtccataaaatgaggtgattttatagaattaaatgacttctaaatcttcatgagttcaagcaatgtgattaaatttcagaaaacatgaacgttattttatgaaaactcctcgatcatatgtttcagtaacttttctatgtgggtcattatttttctagacccaccactgggtagctgtagtctgaaccctgtttaccattctagccttgtctcccatccctttcttaccaaggcctctgcattccagccacatttgtattgcattcagtacctccaacatacaacacttgctctttcagcttttccccatagttgccttttcctgttgcctgactagatcatctgccacgtcttagcctggaggtttcttcctctaggaggcctttcctgccaacactcttgctggtctgattcagctcctctgtaacatttccataggacatcccctaacatatcactattgtcattgtagtgtactggcctgactgcttgtctaaacaccacgttatattatcagatctaccataaggcaggggtgcggtcttcgtgactctgtcttcagttcctagcatggtgtctggcacataccagcacatagtgccctacacctgaatacttaaaaataggttagctcaatcaagaattaattcactgctctgtaccttaggaatattagctgtagtgttcttctctctggggaatggcaaaactaaggaaaattctcctgtcctcttaaaaagttgtggtgggaaaacatcctagttcttgtaagattctcagagagaggcatctcgtaaatctgatcaagcaacagaatgaactatatgaaactgccacttttataggtgaagattggtcaattactagcagatccatgttgcttatcctaaattataatgctcattatactattctcaactacttttaattcattatttacttaatttggcatccctatatgattatcacttcagtagaataaattcatttatttttgcttatttgtgcttactgtgtgctgaggcactgtgataaggaacaaaagataaatacatcttagcccttgacctcaaagaacttataatctagtggaggaacccttccccccgccccctccatagagagtgtgatataatatgtatttttatatattatatacattattaattatatataataatcaatatatattatatatttatatattgattattatatataattaataatatatataattaatatatatattaattgctgtcctcagagttatctacaaagtcaccaattctgcctaaagaaatcacttcaaatagtagcttcctgtgacctatgaactcttaagtgcttaaatataactatttcaaaaaataaatagaacttgactctttaacattactgaatctgagttttagccatgagctactcagcaaaaacaaagaataagtttccaaaagttaattttgtttctttatacaagaaatgaaaacttattaaataattaggaccaaggccatgaagttagttatgaatttttagtgattcctctaaggattcttaatgagaagttcaaatctaagatttcaggaaaaaataaagtgaatttccacaacttaaattgaaacatgaattgacataaacacacccatgacagctgcttccggaagggaagtgtgcagataacaaaattgtgttaaagggatattttgactagtttcataatgccaaatgtcatttttttccggtagtacttgcacagattttttttatttattaaaataacagctacaacttacattaagcttgtagaaaaaaaaaaagcatttcttcttaacattcagtgtaaatggcgtgagtctttataagaatctctttttctagccctctaccctttataagtccataaaaagctaggagtgcctttagcccaagggggagtgtcttgcaaatatgagagaaaaccaaaacttgatcccctggcgggcaggatatttttctctttaaaggaagtgattttgtttggttagatggtgccactggccaccttggcaacatccggggctccttgttcctgctggtcagctagtggtctgtcaaattgcagagggggatgaagctgagtgttcatcatgtgttggttcacccctgtgttactgttccttcatggcccttcctttgcctatatttgttttgctgatttatttgtttggccaggtatgttttcctgggtttttaattgaattctaatatctttgggaggattatgtaatttcctattctccccagattccaccatcccaatttccttcttaacttaacgtctgcataaataaaaggagcactgaagtgtttcttaccatcttgacttgaatatcaccatagttacatttagaatcagcttttaaatggcacttctcctgatataaaaagtaaaattaagattcactagacatctctttatgaatatatttgtgacagtaaatataagttgaagccaatttcctagttcaagtggtctattttggctaagtatgtgtttataacgcatagaaaagcaccaatttaatttaaaacatcattatatttggaacttcagatcattctagtagttattttttcttttatatctacatgtacaaaacagtctcaagtcaattatccagataatttaattctaacaaaaatactttttgctcttatgattatcttaggtaaggagtaatttttgtctaaattgcacagctagttgcctcattatcgaattttgctctgcctgtgtagacacgaattccgtataactacaggtttatactgcttgtcagtttctaacttttcttccttaataattccttgcaaagtgagcaagttatggttgttgggggaactataactttgggtttcctgacattttcatcacttagaaaatctggcgaacgtgctgttatcatctgaagctgccgaagtgagtcaggcagggtttaacaagagggcggcgacctccttcattttaagcatcaatctaccttcacaattttcagcacctaacaacactgccttggttcctaagtgatcagataaaactgctaagaatacaatgagcatgttctccttttcgttgtggatttaaagaagaacaagttataataaacaatagggttattttactattatagagaaaatattgactgtcagattataatttagatttataaattagctttcattaagtttatgaaggaatgtatgttctaattgctattccttttaattatttatacatttctcagagtatttttttttttttttgcaatgacaatttggatggagacctctatgtgattcctcgagaatccactaattgtattacatttaaattaaaacattcaaaattaacacattttcgtcttatttttcaaagaagggtaagacttaagatgtaaatgcttaagctaaatatatcataaattctaagtttaaatcttattgacatatattttcatatatatttttaaatctactaaaataaagatgtttcaagtcctaaaagaggatgccatttctgtgggggataatattcaaaagaacataacttttgttcctcttctttgtaatgagattaaatatgtatagatgacatctgcatctttgctagtatgaaagactgggtcagttccatgacacgtgtttctataatataaataatgtcagattgtagctattaagtgaagaagttaactttgtacatagaaagggcaagtgaaaggaaagcttctcccgtgactaccaagatgagatagatcctgttaatttattccttaatatgggaatgtgaataaaaattgagtctaagaatgaaagccaacttctgtcaacactagtatgccatctcatagccatgcacttaattcaaaaggagtaaacatgtctttcacattcaaattaaattggtcacagtgttttttcccattggatttttttttcaatgccttacatgccctacacgatgtccttttctgtgtcatcatattatgtgttacctccttgtattagcccattttgcaatgctctaaagaaacacctgagactggataatttataaagaaaagtttacttggctcatggttctgcaggctgtacaagaagcctggtgccagcgtcttcctctggtgaaggcttcagggagcttttacccgtggtggaaggtgaaaagggagcaggtatgtcacatggcaagagagggagcaagagggcgctgggaggaatgccatgctcttaaacaaccagctctcccctgagctaatattgtgagggctcactcactaccacagggatgacagcaagccattcataagggattcacccctatgatccaagcacatcccattagggcctacattcaacattggtgatcacatttcaacataagatttggaggggacaaatatccaaactatatcactcatgaaaaatgaacttctaaatccagaaggatgtgttttgtcacaggaggtttttttcccctagtgttttcttagaataaaaaagcagaaaaactactttcattggctgtatttctttctcatggtgatgacaaagtagaacaaagatggaaattactgcaaaattatcttaggtctgacaattctggtagtgtagatatagatagcaacagaaacataacagcttcaagtttcactcacaatctaaaatgtctcatattaaaaatattcaagtgtgatcaacattactcttcaatttttgaagcaaaaatcttcaatactatttttagaatcaacaaatagattttttaaagtgtctaccatcagctgaaaattttaatagctatagacttaagcaatggaaacaatattgcatttcatttttctttgtttgctattcccacaaaagatttgaagatgtaaggaaaagtatgatttatgagatttctcaaatccacacttgtgtgatggtgtactgaaaaatactttgggttgtggcagagatgaggaagagttagtggaagaagcaactaaataacctgcattttcagaagcgtgatttatattggtgacaatattaacacatgaattctgttaggacatcaataaagttgacacatttttaattctgatgaaaataaccccaggcattctgcagctgccctgaagaattttggtttcccacaatatatcagtcccttccaagatacaagccttcacatattttgccctggacaaatgtcttcactggataaaataccacttcttatcaaaacctgccccaaatgttacctcctccgtgaagacttcccagctggatatggttaaattagatgcttcatctgatgcgtgttcaaagaataaggaataaatgaataaattagatgttctcatttaaaaacatatttctgtaaaattttatatacattatggctccaggtggacagataacaattttattatttttaacacctggcatattggtaatatccaataaatattaaatgaatgaacaaatgaatgagtgaagtgatgtattaaatatgaaaaagcaatataatttgttttcaatatatttttaaaagcactttgctaagtttcagcagagatattctttctattggacaggtagatttttatctcactaacctaaaaaattatataagtgacctgaaatttttgagactgagtgcttaaataactatgaaacatctattcattcatttataaaattatctattcagtaaataaacaaattaaaactgcatcatttaaacataatctagttttctaattcattggagtaataacacctgaaccttgaaatgaatattgttccacaagtaagattttaacacatattattttttatgaggaaaattaccatagtcatgtctataccataataaagtttacaatttgctgtttggggagtggaggagggagagaccggaggatggtctcaagcaaatgggggaaaaactattgtaatagtccaagtattcctaaatggacccaaaaacaattggttttactggctacatcatagactcaatataagtattcacttactttgaatacttatattgcaaaagttttttcctacagagtttaaaatggacatttttcaagacatgcctagagaacacactttgtatttagagaagaaattgattgatacacataagttttgtcataagtatatgatgttaattgatctagcatttttgttttaaaatgtattcttttatcatttattaaatggaatgtcccatttaatatcaacaatcaacacgtaagtccatttgaaaaacagtatacatagagtgaatggaaaaccacttcaagccaactaatacattctttttttgatatgaagtggtgaaatgtgaatcaacatatatatgtagacaagccataggtatatattcttactaaatacagattggaattcagatgaaatgaaaacagtatattttagtatttaagaggattcaggatcttgtttcctcggccaggcgcggtgactcacgcctgtacagaatcccagcagtgggaggccgaggtgggtggatcatgaggtcagaagatcgagaccatcctggctaacacgatgaaaccccgtctctactaaaaaaaaaaaaaaaaaagctaggagtggtggctgacacctgtagtcccagttactctcaaggctgaggcaggagaatggcgtgaacccgggaggcggagtttgcagtgagctgagatcgcgccactgcactccagcctgggcacagagcgagactccgtctcaaaaaaataaataaataaaaaaaaaataaaaaataaaaaaaaaatcttgtttccttaaaaatttaacttaacaatgaaagttaaagtacaaaagacaaatgtacggcctcaaatgaaatatctactgatttctcaattaaatttttaaaaagtggaaatagtgtaatattggaaatgaataaaccctatgtccagctaccccattaactagttgtgcaaacttacacaaatccacttgtttctcagggtctcagggttttttgtttaatctgtatgatgtagcacacactttattatttgtagcagataaactctaaagccatctcttactctaaaattttagaaccaccttgaaaacaggcatgcaattgtgtgtatctatgtggcctgagttttgtagacgtaaattgtgtatttcgccataactaaattattgtgaaatctcttaaagtattataaaaactaaagccctatagaatttatttacaatcaaccattttagcgccacctgatattgttaattccacatgtaggaaagaaccacaaacatggtatcactttaaatccataaagattattaattgtataatagcatagacatgtggaagaaaaatttacatattataggagaggaggctaggtatccagactctagctacatttcttttaagtcattttatgaagtaaaatataattataagtattttacccagggagagagctaatgaagccaaggtcgctggttcaattcccttgtgagccattagcttcatttcattccattgtcataggcttgctaccctcttaaccccgactcatcatccttcatattcatactattggttgcaaaggaaatttggccagactgtttgaatgtgtaagcaaaaatctattccctctgctagaaaaataacgcaaagttcaagccttagtgatatgacatcatccaagtatggacagaacagattatcattatgattgttattattactattattattatcatcactattatgttggcagtatagcatcatggttaaaagagcaggctctgaaatcagactgcctatatttgaatctcagtcctcctacttattatctcaatgacttggacaagttatttatctctctgagccttgtttttcttattttcaaaataggtattataatagcaccttatagagttttgtgaggaatgaatgggttaacatctgtagaaaatgcctgacagctattaagtaactattattattttttagttgtctggattatgtggactattcagcacttgctaaaaagcatatgtattcattttccagggctgcagtaacaaaatatcacatactgggtggcttgaaacaacagaaatttattctctcacaggtctggatataagaagttgcaaaccagtttgtattctggaccagactcccttccaaagctctgtagaagaaccctttcttgcctcttccaacttctggtagccctaggaaatccttggcttgtgacagcataactccaatttctgtttctgtttttacatggccatcacctccctgtgtgtatccatgtgtctataaaatttctctctcttttttcttccaaagacatcagcattgaatttatggtgctgcctaatccagtatgacctcatcttaacttgattacatctgcaaaaaccctatcttccaataaggtcgtgttcacagggaccaggggcttgggcttgaaaatatctttttgaaagatacagttcaacccactacagcagacaaagcagaaataaaagaggcattaaacacctgagaagagatggtaaagcagggaggtgtagaagatctgatgcaagcacatatttaggagaaatagataaatagcctcaaaaagtcactaagttttacctgtaattacaatagagcaacacctttcaatgtgggtcaggcagaaacctgcaaacgtatcttcgggctatgaataagaaacaggatgagtcaagcagatttcttctacctaggtggcagtaaaatgctctgaggatcctgatataattttggtcaaattatttaacacaatcctgcaaatggcacctacccacccatgccacaccacctttgcatcgtcaaatcagagattgtgacatattgagacaaatactgtgggccttacactggagatgaggtatccttgatcatctaataaacccaaattaggtaatgatctgaggccagtgtttgccctgtgtcctggatgcctctgggatggtcgtgtgttgcactacatgtttaagcaagtatctcagtctaagctattgtccactcatagactgactgtgtctgtttatggcatttccttacacaggtagttctgaaccaagcaaaggaagcctgatggtcttctgcccaaaactggttaaaaaaaaatggtggctttactctatagtcaatttaataaatgacttggaaagtcctcctcatatcacatcagcatgtcagtttttgccttctgcaaagtaatattcggtttccactgtattgactcaagtaaatatgttcacactatggcaaaatacagctcactgtagcaaaactctcagcgggagaatgttgtacactttggtcacagttacaatttaatttaggggtttatctgtctgcagtgagattatgggaaagaagcataggtatcggaagaaaatgttgatgagggattctgatatttgaaaatggatgagtttccaaaaagaagagcataaaactctctggatcaaattcagatagaaagctggcaggttgcctgatttgtaattgcatcttgaattgagctgtaatcctcaccacttctgaaaacaataagaataagaaaatgataaaccacatttgttttcaatagcaatatttgttcagcattcctaataaaatatttccctgatgttttggtttatgctggcaagtcacaaaattaatgatatgtgttgtgtaaggagggaaaataaaataatgtattttctagggaggaaaagaaaacagtattttgtagaggggtggaaggaaatcctgtattttgtgaagaaaaaaagaaattatttgttagattttctgtaaagtagaaattcatatactttttttaacaaaacaacattttaggtttacaacctatgaatatatgctcttcgtacacaacagtgtgggttttacaccgagccgagaagtgactgtgacaacgttagctggtcttccagagagaggagccaatctcactgcgagtgtccttaaccacacagccatcgacgtgaggtgggctaaaccaagtaagtaagcttctcatacctgtgttaacactttgtgtatttttaaaagcatattctttctttactatgaacctcccccatgtacacatcattttgatagtgaagtgttactggtaaatttttaccaattgcagattgacagggctgtcattgaaaactttagaagggccatttttattagtacccaaataaattagaaatggacacattaaaactaaaaccctggggcccctgtgccattcttaagatgcaaactctctcctactttgacattgttcttgggcctcctgctctccctctgtcatttcctttgcatgaacaacgtaatttctatcataccaggcaattgtgatagacatgtccatgtattaattggatacaatgtactattgttcaccttccttcagagagctctgccctaatatcttgtaactcgtcgctcattagcaagaaccatttaattggattgcaataatggaacagattcttcccagtggatcatcttcagactggctatgggcagaattccagcttgatccagtaaaaggaagcctagacatcaccactggatccacttaaataatgcagggtcgaccctggacctgctgggaacacttttttaacaggcatttggaagagttcacagagtaatctaatctgttcctgcaacgttagaaaccacagtaactgaaatttcacagttacttggtcagtagggtagtattaacatgttaatttgttgtgatctgttaatttgtgtcaatccctgacgactatcaggaaaaaaaccctgaatctaccatgagaatatgtattaaaatcagtcttataggtataacttgagatctggcaaatagtttcatcaaaacttgtcagaataacaccaaatattgagaaatacctgatcaggaaagacccactcaaaacattttatttatgaaagaacactctgctcactggggtaatcatctattgatgatataaaaagatgaaaagtcactactggttgggcaatgtaaccatgtgattttggttacactggatcagccttgaatttggttacagcttaagaagagagatgctccatttaggacacctgagtgatatcaattgtgaattaaagccagaattgaggatatcaattgtgaattaaagccagaattgaggatatcaattataaattaaatcagtaggttaggtttatctgtgtttccacaaaataatccatctttacaaaagaaaactgtctttctctggtttttataaggctgcaggtttctaatgatctgtgacacttgtattgggatctcttaaaccattttaatggaataatataagttaattgatgcttatggctaccctctgaaacacctctgggaaaaatacaaagtttttatctggggatgtgttttaaggcatatttccattcatctccctcttgctctctactccacctcactaactgattcatcttaaaagcctactcataaaggtaggctctcccccctcatctgacatttgaatacttctgttaagatccggctggtgaatttccaccaatataggtcctttatgttataattgcattcctgaagtaactgtgcttataaaaactgacaaacctaatagatctgaagcagctcactgaagtttcattaccttggtaatctgaacctctgaccttcgggatgtaggtaatgcaatctgctgttatttccattcataccttggaaatttttcagataactatttgtgagcacaaaggttaactctcagaagagggtcagtcttgcgaaagcttgttgcattatcattttcttcttttgggcaacttgctatcttaagtaaattaactagtcgatcctctgtgaaaggtggcctattttttgcaattttaattttaaattgttgtcttgattggataggaaaaacatggcatacagtctaatatgctcaaaggcaacaaactatagattgaaaatactttgcagtggaaaatcatgttttaaatttataaatatttgcttattaaaaatcaccttccaatgtatatatatatattttaaagcatggtctttgtctattatgaccctccccatgtacacatcattttggtagcaaaatgtttctggtaaatttttatcaatcacagattgatatgtataagttattaaaaacttttgaagggccagttttaaacattagtatcacatacatgatatgtgagataaaagcgtccctgtgttacttcagttcatttttggaaggcagatgttgcaaattggcaacacagtggccatatttccttcctcctccagcttccatacactgttttgcccacagtatttgaaaaaataatatttgcaaacatttaagaattatacataaagataatttgaggattcacttgacaagtcaaatgatggggtgaaacaatacccacatttctggaaggaaactatcagctggaactggcttcccctttagacagatcatgccctaaaaatctgacccggtccccattttcctggtcccaatagacaggtgatgtttatccctgctttatatgataatacaaaatattttgccctaaacaaaatacaccaaagataaattatattgtaattttgaaaaatcacagtttttgtatttgaaaaatacctcacttaaattatttatacaatcctcagaaaagcacaatgagatagaaaccagcccatagtaacttaccaaaaattatagaaagtaccagttcccaaactcaaacttaggactcaggcatcaaattttctatttctcatgcgtttagacttaacagtcattaacactttaacaagaaggatttaaaaggatccttctcatcttgactgctcagtctaaaatagaaggcaaaataagaaaatgcctaccaaagggagtacagtggagagatagtgcctcctttgaagctgattcactaaggaagtcagttgtggccagaaaagagcagtaaaacactggagggagtgagagggcaatgctttgtaaaagaggaaatgaaaaatcatcaaaatattgtctactttactgtctgtcaagagctcaccccaaccttcagatgttcatatcttgtatcatataatcctcctggtcttgctctctccttcctctttttttccatcttccttctttctctatttccttttttaaaatgtttttgtagagacaggttctccctatgcttaggttagtctcgaattaatgggctcaagtgatcctctctccttggcctcctaaagtgctggaattacagccataagggaccatgcctggccatttgtctatttctcttcttctaccctctctctctctctctctttcttcctattttccttccttcctcacagatacatttatcactttctctgtcctgagcactcagtgaactctggaaaatgcataaagtatgagggtatcatcattaagagggcaagtttaaaaccacagaaaaagcatttgtctcatcctgatctcttaatcagaaactaccaggtttgatagctagaagtatatctgactttgcctgaatttatctgattaaggtggcaatatctgtaaataattccaaatctcatctcttctaaaaagcacctaccattgttgcctcaccttgttcctctgttctcttttccatcactttagttatcaaatagaagagaccacatctgacttttccattgtcttccttctcagtcacttgtgcacctgttgtaatctgtctctcttcacttgtactctacatggttttcttaaagtcattagttatcacctaatgacccatttcaaaactctcttctcaatgccatcctactgtgttcctcttgtatccagcactgtgaatgatcccttactgactataattcttccccaataatcattactcccctcttctcaccaactacttcttctcatccctaaagatgtttctcaaagttctttcctgagtcttcctatcatactcctgttctcttgttggtgattccatctatactcaaggtttcaaattcttctaattacaaaaatgacaaccgccaacattgtatgcagccatatgaataaatagttttaaaatagactttgggatcagggatacttaaatttgaatcccagttccaatatgttttggcactacgacctagaatttaacctgagttccagttttctaatcagaaatatgaagataataactgccctgaaatctgttaaggactaaatgaaataatatatgtttaacaattagtaatcacctagtatttgtaatacagagtattattctatttctaaaatgtgcatggtcctttcaataccattttatataatatataaaaggggaagccatgtctagtaaaagcttggaagttgattttgcaagactattcagataaaagcattttttttattattattatactttaagttctagggtacatctgcacaacgtgcaggtttgttacatatgtaaacatgtgccatgttggtgtgctgcacccattaactcgtcatttacattaggtatatctcctaatgctatccctccccactccccccaccccacgacaggccccggtgtgtgatgttccccttcctgtgtcctagtgttctcattgttcaattcccaactatgagtgagaacatgcggtgtttggttttttgtccttgctatagtttgctgagaatgatggtttccagcttcatccatgtccctacaaaggagataaaagcatttctacagtgagttgaagatgcataaagaatatatgttattttataattacctgacttggctaaaagatagaaatttaaaaatctagttaaaatgttgaaaacttagtctgggttccatggctcatgcctgtaatcccagcactttgggaggccgaggtgggcggataatgaggtcaggagatcgagaccatcctggccaacatggtgaaactccgtctctactaaaaatacaaaaattggccaggtgtggtggtgcatgcctgtagtcccagctagtcgggagactgaggcaggagactcgcttgtacccgggaggcggaggttgcagtgagccgagatcgtgccactgcactccagcctggtgacagagtgagactctgtctcaaaaaaaaaaaaaaaaaaaagcgaaaactactaactattgcatggcatccattctcctctttttcttttagtgatagccttgccccttatctagaaactgcatttactaacctcccttgcaattagtcatggccaggtgaaataccagtagtatgtgtttgtgtcaatagaaagtgaaagacaatctgcatctttttgggtattaaccagaaaacactgggtgtgtgcctacttgttctcttttagcccttcccctggactggaatgaggacatgatcatgttctcaggttcaactatgcagtcgtgtacaacacccaaagagatccaaaatccccataagagaaagttcctgggttcttaagtgaccacatggagcacagtctgttttgatcactttgaagctattacatgagatacaaattaacatggattttatttaaactattatattttggagattttaggtttcaccagcttcgctaactaactcattccctgtttgcccatatcaatttaccttaaaagtagaaattagctatcctgttttttaactaaatataaaatgatgaataattaatatatctattatactatctcctttaaatacagttttctctggcaggcccctgatagaagctggaacactatgagagactaaagtagctctggagtttccaaagtgcaggtgtttggttttgacagatgggtaaactagagacaagacaggagatatgctgctcggaaaactaaggaggctgacttgaaggattattgcccaagaagttaatctttccacttcatgtcagcagtagtaccctcaggcagagtaaagaattttctcaagagcagttttgacaagctcaaattttccaagagctgcttagttggtgacgcagagccctgcaccatagaacttggaaaattggactctaatttggagattctgcgagcaagatcaagacttccatcataaaatcagcttaataaggtccttccaggtttttacatttgagcaacattacctcccaaaatgagcctgctaatgtgagatgtctgaagaatttagtcctagacaaataaattaagagatctaataaatgaaatgatttactataattgatctgaatcagtacaacaaactttttttgtaaagtgtcaaatatgtataatgttagactttgaagcccatacagtctctgtcttaactcaaatttgccactggagcacataaacagcaataaggtgattctgatttttaaataagcatggccatgttccaataaaactttattttggacattgagatttgattttcatatattaggttggcacaaaagtaattgtggttttcgccattgaagtaatggcaaaaaccacaactactttgcgccaacctaataattctcacatgtcatgaaatactttttttcttttgtttttttcccccaatcaaataaatgtacaaaccattcttagcttgcagggggtgggccacactaggccaacaggccagatttagctcatggaacatagcttgctgacctctaatgtagatgttaaaaatctagaagacataattgacattgataattgtcttggtctgtttgtgttgttataacagaatacctgaggctgggaagtcaataaggaaaagagttttgcttagctcatgattctgcagactgtacaagaagcatggctgtagtatttacttggtttctggtgagggcttttgtgatgcattaaacatgacagagaaggtcaaaaggtgagtggacatgtgcaaagatgcaaaatccaagggatgcccggctttctaaaaacccactcttgagggaactaattcatttcttcaaaaactaacccagccttgccagagcaagacaccaagccattcatgagaatctggccccatgcaacaaacacctccaactaggcctcatcttccaaaactagtacactggaggtcacatgaggtttggtggtgatataaacccttgatccccctttgctgggaaccatggcaataatttaaggccatgtaagaagcacaatctacttgctgttgcaggataacttttaactagcccgtctgttatggactaaagccctaattctcagtgtagctgtatttggagacggggcctctaaagaaatacagtcatcccttggtatatgcaggcgattggttccaggactgccccctaagtacaccaaagctgtgcatactcaagtccagcagtcagccgtgcagaatccatgtatatgaaaagttggccttctacacgagttttgcatgggagaatactactttattttttttggagatggagtctcattctgtcactcaggctggagtgcagtggtgtgatctcggctcactgcaacctccacctcctgtgttcaagcaattctcctgcctcagcctcccaagtagctgggactacaggcacatcccaccacgcctggctgattttttgtatttttagtagagacggggtttcactgtgttagccaggaaggtctcaatctcctgacttcgtgatcctcccgcctcggccttccaaagtgctgggattacaggctagagccaccatgccagctgagaatactatattttcaattcttgtttggttgaaaaaagtccctttataaatggacccaagcagttcacacctgtgttattgtgttgttcaagggtcaaccgtaattaaggttaaatgagattataagagtgggacctcgatttcataagttagcacacaggctcgcttgctctttctctctgtctctcccccaaccccttctctccctttctccgatcacagaggaaaagcatgggaaaactcagcagctagaaagtagctctccaaaagccagggaaagagccctcagcagaaactaaatttgctggcgccttgatcacgaacctctagcctccagattgtgagaaataagtttctgttgttcaagccacccagcctttaatattttgttaaggcagcccgagcaaactaatacatatctaactactgttaaaattatttaggaattcattataaaggagaggagcctgttctatatttgagaatttgctccagctaagataaaatttctgaccaaggattggaggttgcaactaaaaataacatttaatagcaaagctcttatccaaaaaggttacaacctttttcagctcactgagattgtaatagtctgttctcacattgctataaagaaatatgcaagactgagtaatttataaaggaaaaaggtttaattgacccacagttctgcatggctggaaaggcctcaggaaacttacgatcatggcagaaggtgaagagacgacatgcgagataggtgagagagagaatgcacacataggaggaactgtcaaacacttatgaaaccatcagatcttgcgagaactcactatcatgagaacagcgtgggggaaaccacccccgtaatccaatcacctcccaccaggtcctgcccttgacacatgggtattatggagattacaatttaagatgagatttgggtggggacatgggacctaaccatatcagagattaacttgatattcccacaagtagggcaatacctgctcagataaatttatgtggtccacaaaatatgcatcatacataataggattagaatatctgagaaaatatatcccaatatacacatatttaacataatctcacaggaaatcccgatttctttctattgcatcaaatacaagcaagtacaagccttaactccatattgtataactgtaactcaaacattcacattgtagtttttaagttcacctagttgccacagaaacacttgaaagataacaaaatcctaagctccaacaaccatctgagtggatccccacttggccaaggggacaccagagcaaccttgaaaactgagttcttggctacagtgggatgggaagtcagacacccctccctggctatacaccattagggttacttccctaagtgctaagcagaaaccaccctttcaaaagattccaccactgatatcaaccaaccacctgatgctgcccctcttctactaactgatgagagacctctggccacagagttgtcatggccagtgtatggagaatctgcagtcagggtcttcatgtcctcttcttcactgcttgatgtcagagggctgaaaactccaccctcagattgtgctaatgctgccatttttgtacgtgggatgcaccaggggatgtaaaactcaattgcacatgtgcgtgtttctcctttcataaatactcatgactcttcctgaggcttattgaatatgtatattcagtcaccccactcagcataaattcctgttgctcctcccttgaagaatcttttctggcttctggcttaaggctaccatatgcttcccaggctgtctgaatggccatcctgcaggctgcaaccctttatgagaagtaaagctctccttttcaaatttatgaacctcttctgttgacacacttcaaactcaagaagtctcaaatgaaacaagtttcaaaatctcatcccataattccatgttttctatcttatttaatgggattcacccagaaactaaaaccaaaaatctaagctatagctgtatctcttccttatccctttttaatttgtttatttacttatttgtacacgaataagttctttagtggtgatttttcagattttggtgcacccatcacccaagcagtatacactgtacccaatggttagtcttgtatccgttgcctcccttccacccactcccccgagtgcccaaagtccattgtatcattcttatgcctttgcatccttacagtttagctctcacttatgagtgagaacatatgatgtttggtttttcattcctgagttacttcacttagaataatggtctccagttccatcaaggtttctgcaaatgccattattttgttcctttgaatggctgatacacacacacacacacacacacacacacacacacacacacacacaccaaatttttttatccactcattgattgatgggcgtttgggctggttccatgttttcacaattgtgaactgtgctgctataaacatgcatgtgtaagtatcttttcatataatgacttcttttcctcttggtagatacccaggagtaggattgatgaatcaaatggtaaatctacttttagttctttaaggaatctccacactatttttcatagtggttgtactagtttacgttcccaccaagtgtaaaaatgtgttctttgtatcacatctatgccaaggtctattattttttggttttttgattatggccattcttgcaggagtaagatggtaccatattgtggttttcatttgcatttccctgatcattagtgatgttgagtatttttcatatgttttttggccatttgcacgtttcttggccattcttcttttgagaattgtctattaatgtctttagcccactttttgacttgattgtttgtatttttcttgctaatttgtttgagttgcttgtagattctggatattagtcctttgtcagaagtaaagatttttaagactgtctcccactctgtgggttgtctatttactctgctggttatttcttttgctgtgcagaagctttttagtttaattaagttccaactatttatctttctttttgttgcatttgcttttaggttctttgtcacaaagtctttgcctaaactaatgtctagaaggatttttccaatgttatcttctagaatttttgtggtttcaggttttagatttaagtctttgttccatcttgagttgatttttgtacaaggtgagagatgaggatctagtttcattcttctacatgtggcttgcaaattatgccagcaccatttgttgaataggttgtcctttacccactttatgtttttgtttcttttgtcaaagatcagttggctgtaaatatttggctttatttctgagttctctattttgtttcattggtctatatgcctatttttataccagtaccatactgtttttgtgactatggccttttagtatagtttgaggtcaggtgatgtgttacctccagatttgtccttttagcatagtcttgctttggctatgtgagttcttttttgattacatatgaattttaggatttttttcaagttctgtgaagaatgatggtggtattttgatgggaattgcattgatgggaattgtgttgatggtaatttgatgggaattgcattgaatttgcagattgcttttggcagtatgatcattttcacaatattgattctacccatccatgtatatgggatttgttttcatttgtgtcatctatggtttctttcagcagcattttatagttttccttatagaggtctttcacctccttggttaggtagattcctaagtattttactttttatttttgcagttattgtaaaaggggttaagttattgatttgattctcagcttggtagctctttgtgtataacagtgctactgatttgtgtacattaattttgtatcccaaaactttgctgaatttatttaacagttttagagggtttttggatgactctttagtcatccaaatgtctctagggttttctgggtacacaatcatgtcatcagaaaacagcaacagttggacttcctctttagctatttggatgccctatatttttttctcttgtctgattgctttggctaggatttacatactattgatataggagttaaaaagaaattaggcagatagggatggtaagagagtcctcaataaggttttccttttaatggagagcagcagcccccaaattatctcttttctgacaaagagcagcctgttaaattgaactgcagacatagataagcaagctggaagcttgcatggatgaatgccagcagctgcaccaacagaaaaaggctacctgggggcaaggcatgttcaacatagtggctccatctgcccttttctttgtcgagcacatgtacagtaagaaacagacaacatggcactggccaggtagagaacccatctgcataacaaaagattaggatggggtgaccaggttattcatgcactatgtaaatggcacacacagtcccatcaatctttaggccctatgtaaatcaggcactgcctcctcaagccagtctataaagctccgtgcactttgccgtggactggaagacccatttgggagcccttctttctctgcagaagagagagctattctcttttctctttcttttgcctattaaacctccactctgaaacttactgtgtgcctgcatccttgatttccctggcatgagatgatgaaccatggatatttaccccagacaatgatgctgcttcagtatgttgaataaaagtggtgaaagtaggcatacttgtcttgttccagttctcagggggaatgcttttgatatggtttggctgtatccccacccaaatctcatcctgaattgtagctcccataatgcccacatgttgtgggagggacccagtgggagataattgaatcatagggtgggtctttcctatgctattctcatgatagtgaataagtctaatgagatctgatggttttataaaggggagtttccctgcacaaactctcttttcttgtctaccgccatgtaagatgtgcctttcaccttccaccatgattgtgaggcctcccaagccatgtggaactatgagcccagtaagcctttcttttgtaaattgcccaatctccagtatgtctttatcagcagcatgagaacagactaatacagtaagttggcaccagtaaagtggtatgctgctgaaaagatagccaaaaatgtggaaacaactttggaattgggtaacaggcagaggttggaacagtttggaggattcagaagaagacaggaaaatgtgggaaagtttggaactccctaaagatttgttgaatggctttgaccaaaatgctaataatgatgtggacaatgaaatccagtctgaggtggtctcagatggagatgaggaatttgttgggaactggaacaaaggtgactcttgttatgttttagcaaagagactggcagcattttgcccctgccctagagatttgtggaactatgaacttgagagagattatttagggtatctggcagaaaaaatttctaagtagcaaaacattcaagaggtgacttgggtgctgttaaaggcattcagttttataagggaagcagagcataaaagttcagaaaatttgcagcctgacaatgtgatagcaaagaaagtcccattttctgaaaagaaattcaagacagctgcagaaatttacataatttacctaagtaatgaggagccaaatgttaatccccaagacaatggggaaaatgtctccagggcatgtcagaggtcttcatgacagctgcgaccaacacaggcccagaggcctaggaggaaaaagtggtatcaagggccagacccagggttcccatgctgtgtgcagcctaaggacttggtgccctgtttctcagtggctccagccatggctgaaaggccccaatgtagagcttgggccacggcttcagagggtgcaacccccaagacctggcagcttccacatgatgttgagcctaccagtgcacagaagtcaagatttgaggtttgggaacctccacctagattttaaagtatgtatggaaacacctggatatccagatagaagtttgctgcaggggcaggcactcatggaaaacctatgttggggcagcacaaaagggaaaaggggtgggtgcctccacactgagtcctcattggggcactgcctagtgctactgtaagaagagggccactgtcctctagaccccagaatagtagatccaccaacagcttgcactgtgcacctggaaaagcacagacaatgccaacctgtgaaagcagccaggagggaagctgtaccctgtaaagccacaggtgcagagctgcccaagaccatgggaacccacctcttgcatcagcatgagctggatgtgagacatggattcaaaagagatcattttggagctttaagatttgacttccctgcttgattttggacttgcgttggggcctgtagcccttttgttttggccaatttctcccatttggaacagctgtatttacccaatgcctgtacccccattgtttctaggaagtaactaacttgcttttgattttacaagctcataggcagcagggacttgccttgtctcagatgagactttggtctgtggacttttcagttaatgctgaaatgagttaagactgtgggagactgtggggaaggcatgactggctttgaaatgtaaagacatgagatctgggagggaccagggcagcatgatatggtttggctgtgtccccacctaaatctcatcttgaattttagctcccagaattcccatgtgttatgggagggacccagtgggagataattgaatcatgggggcgggtcttttccatgctattcttgtgatagtgaataagtctgatgagatctgatggttttataaaggggagtttccctgcacaagctctcatttcttgtctgccaccatgtgagatgtgcctttcaccttctgccatgattgtgaggcatccccagccatgcggaactgtgagtccattaaacctctttcttttgtaaattgcccaatctcaggtatgtctctatcagcagcatgagaacagactaatacagctttccacttttccccattcagtatgttagctgtgggtttatcatagatgacttttattacattaaagtatgtcctttctatgcctattttgctgagggttttaattataaagggatgctggattttgtcaaaggctttctctgcattgattgagatgatcatgtgatttttgttttcaattctgtttatggggtgtatcacatttattgacttgcatatgttaaaccatccctgcatccctggtatgaaacctacttgatcatggtgaattgtctttttgatatgctgttggatttggttatctagtattttgttaaggatttctgcatctatgttcatcagggatattggtctgtagttttcttttttgtcatgtcctttcctgtttttggtattagaatgatattggcttcaaagaatgatgtaaggagtgtttcttctttctatatcttttggaatagtgtcaatatgattggtacccattcttctttgaacatctgatagaattccgctgtgaatctgtctggtcctggactttttttgttggtaacgttataattaccatttcaatctcactgcttgttattggtctgttcagagtttctattacttcctggtttaatctaggagagttgtatatttccaggagtttatctaggttttctagtttatttgcataaaggtgttcacagtagccttgaatgatcttttgtatttctgtggtatcagttgtaatgtctcctgttttatttctaattgagcttttttggatcttctctcttcttttcttggttaatcttcctacatggtctgtcaattttatttatcttttccaagaacaggtctttatttcatttatcttttgtattgttttggttgtttgtttcaattgcatttagttctgctttgattttggttatttcttttcttctgctgggtttgggtttagtttgtacttgtttctctagttccttgaggtgtgaccttagattgtctatttgtggtctttctgagtttttgatataggcatttaagactatgaactttcctcttaacactgcttttgttatatccaagaagttttgataggttgtatcactattatcattcagttcaaataatttttaattttcttcttgatttcattgttgacccaatgatcattcaggagcagattatttaatttccatgtattggcatcattttgagtgttcttattggagttgatttccaattttattccactgtgatctgaaagagtacttgatatgattttaattttcttaaatttgttgagactcattttgtggcttatcatatggactatcttggagaatgttccatgtgctgatgaatagaatgtatattctgcagttttggggtagaatgttttacaaatatctgttaagtctatttgttctagggtatactctaagtccattgtttctttgttgactttctgtcttgatgacctgtctagtactgtcagtggagtattgaagtcccctgctattattatgttgccctttttaaactcctatgtgtcaattaaagacaggctttttccatctagtgaatccaccattccccagggccttagagtcctaccttagatgggaaaactagaccctcatagacggccaattgctccttcacatctcagtccagatgcatggggcccagaaaatgtagttcaatgatttgacaagaagagaaaaatgttggtattagggagttctagaaatctttgccttcagattacagaagatagcttttatcttccgactatattttaaaatttaaatggtattaatgatattaatggttactaatgtctttctctgttttttcatgccattctattttatatgtaataaagaacttaatatgctgttacttttcttgcctttctcatctgctgttttcaatgttcagtttattattattgttaatattgttgttatgatataatttttttatgcaactattttctctaaatagcttcagtacttatcagcaattcttaaactttcccaatcttgagttctggatcttgattaatctttctgtcttctgaagaagattattggatagttttatcatgaaacttaaaaagatcaattaattagttttatgttctctaaatgtttggtgatataagaaagtatttctctcatctttgcacattctcttaaatttgcccaaataagaaagtatgtctgttgtttttacacataagtaaccatttaaatgtgtataaaattcttggattaaactatttcccctcaaaacttgttgaaattgttccattgtctttcaacatttgacattccacataagaagtttgaagcttatctgatttttttctcctttataaatgttcctaatttttggtttacctttaaaatgtttcaatattccatgatatgtctatgtttggatatattgtgattattttggagaaaactgtattagtctattcagtttgtagacataagtcattttgggtaaggtttattggggcatttcatatccataattatttattgcatttatttttaaggtaattagactttttctgttctcgatgtctataatttttactttcactgatgtccttgtcattttcctgttaattctttgatattgtgcatttttaactctgctcatttctgctttcaacgtacgttttaattctgccattgctttacatggttccttgctctcctttcttatttaaggcagacccctttacatctctgtctttgtggctgtctttttatgattttacaaacctacttcatagaggcttctttttcataaagtaatgtcccttttttatttttggtacaccatgcaaatattttataaaacctccatcccattgtcatagaagtaatatacacaaaacttctgccttggaaggttctagacaagatttcccttgtcttatgctaggaagaagccttgtaacttatgtttttctatttaaaaaaggagagatacattcagacccagcttttctcaatagacagggagggtgaaatttacttgcctcttcattcagctgtttccatgttaatagccttcctctctcagaggtaaaatcaaggtcatcagcctttaattttgtgctggtctattgaactgaagatgtatcttctgtttcttagatggttcactgacttaggaagagtacatcaaagtttaaagaccttatttgagcaatgaaaaagatgcttctatgcatgtactgctcccagaacttctcatgtgataaccaggaacatgtataaaattgtatgtgtttctacatttttctatgttttggacttccaagtgtaacatccacatgagtggagaaacaagtgttgaagcaaatgttggaaacagggagaataggccagaaatccggtacttgttacccagaagtgctgcctgtttctgttctcaagagcctccatatcatgcagtaagacataaacaatggaacggaatcaccatcttttcctgttgtcctaggttctgttctgtttcagagggactggcatacggtgcatggctaagaaaggacatttaatggggtctcatccagacattgacatgtgatctttgctcatcttgaacttgtgctagtggaaatatatttaatgtatctacataggtatattaattggaacttgatagtgcagataacaggcacatttaataacccaagtgaaattaatttatatacgtaagtgaagtttgaaagcatttcattaatattatatctttagggcttgactttataatcagcctgctcacttaacaaactaaaattcaacataaactacaaatctagtacactttgcattataccatagcagccacaaattaatgagtaataaataatgctgtgagacagtagaaaatgatgctagtaacagaagaaacgtttgcactcactacacccatggctttgctgtacttgacgaatattatcattcaggaaaatgttaagggattttaatagtcagttcctgccgatgatcaataatgacctcattattgcatgtgcttacatttttgtgacatcagaggaaagaaacactgcaaaacccagaattttccaaattaattgctaaaggtcttccaatacaaactcttccaactacactggcacatcatacccttttaactatttctagagctaaagtgaaagcagtagtgtatttaggaaaaacaaaaagaaaaacctagtattcagtttttatgcaaaatcaccaagactttaatgtaaaggggtcctttaaagaaacatactattctcaaagctatattactttatatggccatatgctgggatctcacatataagtgaaattggacttcaatagccataaggagaaatgccactttttcctcccaatccttggactaatgctgtttaactttttttctttttttttttttcctgagacatggtctcattctgttgtccagcctggagtacagtggcacgatctcagctcaccacaacctctgcctcctgagctcaagccatcctactgcctcagcttcctgagtagctgggactacaggtgtgtgccatcacacctggttagtttttgtgtttcatgtagagatggggtattgccacgtttcccaggctggtctcgaactcctgagctcaagtgatctcagcctcataaagtactaggattacaggtgtcagccactgtgcccagcctgagcaatttttgatgcataatttgacatgaaatttcagaaggcttgtaagccaacactccacccccatcctaacaaactaaggtaatcgtttctgcttaaaagtctctgaaaataatactgatgtaagtagagcagcataatacttcctacctaagaaaatatggctgttttcatgttctcttgttaaagaatcattgtgggcagataatgagaagcagagcctaaggaaaagaatggataaattgggaggaagaggagaaaaaataatagactggtctttgaaaggataagggttgaagaattgatgagttatatttgcaagacagttagtgattgattttggtatcttttaaaggcttctctacattatagaaacacattgaactagaagagaaggatgagagccctgataaaaatttaagtattatcctgagccagtccttaaggggagcatgctatgtagccctgctacattgacaatgtatataaaaggatatctttctaagcatccttctaggtatcagttagcgaatgttgttagcaagttaaaaaaatgtctctaggatctgtgtcaggaaatgctcttatttgtattagcctagtcttctctctaagattatgttacttatgagcagaagttgttctatgtactgtatactttcattttcatcttagtttcctttcataagtgttatatcaaagttctgatgattcattgaataattataagtagcaaaattaaaatatttaaaggaaattaaaaagatgagacttttataagactcatattcctacataagactgcaattaattatgagattgggaaaaaacgcaaattattaaaaaataaaaactgaccaggtgcagttgttcatacctctaatcccaacagtctgggaggctgaggtgggtgaatcacttgaggccagaagtttgaggccatcctgggaaacatagcaagaccctgtgtctacaaaacactgataaaaattaactagtgtgatggcctgagcctgtagtcccagctacttggaaggctgaaacaggaggatcgcttgagcccaagacatcaaggctgcagtgagccaagattacactactgcactccagcctgagtgacagagcgagactctgtctcaaaaataaataaataaaataaaaactatcaccaccagcaccaccaaaaaggagatctcataagctttttttaacatttccaaaacaaaggctctctaaacttctttttttctcattctagaaagctaatgatagaattttttttttcccctgaaagcctcagctacattcaccatgtcctgcatttattgttgacagctgttcaagacctacaaggtgaagttgaatattacacacttttttggagttctgctacctcaaacgactctctaaaaatcttgccagatgtaaactctcatgtcattggccacctaaagccaaacacagagtattggatctttatctctgtcttcaatggagtccacagcatcaacagtgcaggacttcatgcaaccacttgcgatgggggtgagtccagattctaaaggatatttgcctcagagatgcgaatgaaattgattgattcttgccggggttgagatcagtcatccctccattataaaatttccggtgtgggagggaagggggtggaggctaaaatgcttaagtgctcactgtcatcagtagcagatcaataagcagtcccattgagacagaagcacaagctctaataatgagatattagcccagtttgttcctgttcttttcagtgtatacttattttagaactgagttcacatcaataaatggtgacatttagaaactttttttttaagatttgccctcagaagcagtacgtttttcaaaacgacagccaaacacagtgagagccctccctgagtcaccagaaatggtaggtggaagttcagccactgagaaaaattgcctgtgactcatttctaagccagttagcaagggggaggaagcaagggaagcaacttgtgaatctgaaatgtgtttggaatggtctttctaatcttttttggctttataaagtctcattataaacattataatatcattacctcccaagcaagtgttccaggtcattagcagagctctttaagtgtggaacccatttccctttgtggtgccaaaggtcggcaccttttgtttataaaatagggtagatcacaaggacaattcttcaactagttaagatgggttcttatgataaaaataggtctttgcatagttatttctgacatgcttgaataattatgcaatttaacgctaagcaagatttttttcttatgttagatttcatcattacctatggtaatcaacattcaaaatcatttacataatgacaatattgcattattgcttcatattgcttgagttacaagctagtaacatcaaatgatttttcacgttccaccagcctcattgtatttgagttttattttttgctcaaggagcaaattttatttccttccctccctcccctgcaccttggaggtatagagtgaaaggatggaaaaaagacaaaaaatagataagtgttagtggtgcagatgggtgaataatttatcatcatatcccactggtcacatagtattgaagattagcactatgctggtggtataaagcattttaccaccaattcttatggtttctaactgagagtataataagccaatttacagaggactacagactgtgataacttcatcagcgaaaagcagataagcgaggaaccctttgctaaacctaaatactaatctgcatttagcttaacatgtgctttttcagagacagctggagtttattcagtttcttcctttaattctagagcctcagggcatgcttcctccagaggttgtcatcatcaacagtacagctgtacgtgtcatctggacatctccttcaaacccaaatggtgttgtcactgagtattctatctatgtaaataataagctctacaagactggaatgaatgtgcctgggtcgtttattctgagagacctgtctcccttcactatctatgacattcaggttagaacattgttttttgatggttaggcttatggatatgttaaataaaacatgccaggctatgtcttcaagtggatatcttctgtcttggttacagattatttctttggtggggaagggaaaagagagaagggaaattgatcagaattaaatctgtgtgctgtaggcaaacatgtgagtctctggagagaagataatgataatatggaaaacgatggtgatgaggatggtgatgaaattctcactggcaaaataaagctaatcatgtattctaaataaatcttgttgagcagcttaccttttcccaggatcttttactgaaatcaaaatcagaatcagtttgtaaatgtggagatgtttttttctcttcccatttctcctatttactaatttaatatctccagagaagttatgaaacttcacttggtgtcaatttcctcttttgtaagcgcaatggactagatgtcttaaaacattctagccacctctagcattctgtgattctgaatgcaacaggaagacatatataaaaaatatagcagacaaaaaatattaaaaggttttatctgaaggtgaaagaaatatatttattcatcactcaaaaaatgttcaatgttctccgcatatgtgagagcaattgtggttaaaattttttgcccttggacttctttgagaatcttatgaagtcagtgtactctgccttagaaaaatatttatgcacttgtatgacaaaatttaacacataatttcagaaagtgcactgatcacttgaagtcaaattcatagacttcttcaggggctactggccttaaaagtagaaaaagtatagggaatactaaggcatataaaacaaggaacttatcttcacggaattggaaatcttgttggagtaccaagccataaaagataacaaggctaaatgtgcaaatgagtgataaaaaaaaatcagagtatttcagaaaccccacatttagagaaagcttgcaatttacaaaattttttaataaactatgctacttctaaaattcataagagcttcgtaagataattttcagaagatattaagcacagaaattttatatgaccacagaaactttttactggttctatccatttaatagtactacctcattcaggtttccatctccttttcctgacatttgaggttaagacatataatcatctggctacaaccaacactttagtctcccctactctgactcatagacctagcttcctaagaaaaccaaataaaaatatctttgaataaagaagaaaggtacattaattatttttctttttttttcatttaaatgtattttattttaagttcctgtatacgtgttcaggacatgtaggtttgttacctaggtaaacgtatgccatggtggtttgctgcacctaacaacccatctaccaggtatttacctgtacatgtattattagctatttattctgatgatctccctcccctgatgcccccccaacaggccccagtgtgtgttgttcccctcgctgtgtccatgtgttctcactgtacagctcctacttataagtgagaacatgtgatgtttgtttttctgttcctgtgttagtttgctgaggataaaatggcttccagctccatctatgtccctgtaaaggacatgatctcattcctttttatggctgcatggtattccatggtgtacatgtaccacattttctttatccagtctataattgatggacgtttgggttgattccatgtcattgctattgttaatagtgctgcaatgaacatatatgtgcttgtatctttataatagaatgatttatatttctttgggtatatacccagtaatgggatggctgggtctaattgtgtttctggtcctaggtctttgaggacccaccacactgtctttcacaatggttgaactaatttacattcccaccaacagtgtaaaagcccttctatttctccacagcttcaccagcatctgttgttacttgacttttcaataatcaccattctgactggcatgaaatggtatctcactgtggttttgatgtgcatttctgtaatgatcagttatgttgagctccaggtgcccaccaccacaccaggttattcttttgtgtatattttcagtagagacagggtttcaccatgttgaccaggctggtatcaaactcctgacctcaggtgatccacctgcctaagcttcccacagtgctgggattacaggtgtgagccactgcacccagccaagtatctactttttgaataatccctttatatgtcccttttacaaagaaataataatttcatttttattcagttttacctctttttaatataaatatagtaagctttatatgtttgttggccgcataaattcttctttggagacgtgtctgttcatgtcctttgcccattttttttgatggggttgttttttcttgcaaatttgtttaagtttcttatagattctagatattaaacctttgtcagatggatagattgcaaaaattttctcccattctgtaggttgcctgttcactctgaggatagtttctgttgctatgcagaagctctttagtttaattagatcccatttgtcaatttttgcttttgttgcaattgtttttgatgtttttgtcatgaaatgtttgcctgtgcctatgtcctgaatggtattgcctgggttttcttctaggatttttatagttttgggttttacatttaagtctttaatccatcttgagttactttttgtataagatgtaaggaagggatccagtttcaattttctgcatatggctagccagtttttccagtaccatttattaaatagggaatcctttccccactgcttgtttttgtcaggtttgtcgaagatcagatagtggtaaatgtgcagtcttatttctgagatctctattccgttccattggtccatgtgtctgtttttgtaccagtaccatgctgttttggttactgtagccttgtagtatagcctaaagtcaggtagtgtgatgcctccacctttgttctttttgcttatgattgtcttggctatacaggctcttttttggttccatatgaactttaaagtagttttttctaattttgtgaagaatgtcattggtagtttaatgggaatatcattgaatctattaattactttgagcaatatggccattttcatgatatttattcttcctatccatgagcatggaatgtttttccatttgtgtcctctctgattttcttaagcagtggtttgttttcattgcacaccatgattcccatagcctacctgagttgtcttagcatggaatatgtggactgatgtttatgttcatgattcttatggtgagtccatgtatgcaggtagaccataggccaaattatgaaatagaaatcatgctccaaataaattagaaatatagctatataaaaaaggctaacacaggaaggtgatggaggatttgccgtattgtcttcttttgaccagtgttcgggaaagctgagttttcaaaggcaccttattcatttgctttaccaagactcgaaacacacaacctagaagtgagaacactgtgtgctgtgcatgcatgtgcagctcagctttctgactctggatcaagagttaacgtttaaaagtgtttaaggcctattctatggaaaaggctttatttataccactactggtttgagtcaggtataaataactcaagccagtaggtataaagcctcctcttctggtagcctgaggagagtggaaacagatgaaaatacaaaagatcaaagtagaatccaataatagaattttgttattagtgcctaagatattcttattactgattactatattttttgtgaagctttttgcagtccaggaatactgtacttgatatagctgttgcatttctggaaatttgaacatcaaatttcagtgattttcattacgatgtcaaaggtgatttagtttcatttaaaataagcatttgattggaatgcctaatactttagaattaaggctctctatgctaaccccatctgtaaaatagctattgattttaaagcacataacacactcaagtatctacttttttttttttttttttttttttttttttttgagacagagtctcactcttctcacccaggttggagtgcattggcacgatctcggctcactgcaacctctgcctcctggaatcaagagattctcgtgcctcagcctcccaagtacctaggattccaggtgcccaccaccacaccaggttattcttttgtgtgtattttcagtagagacagggtttcaccatgttgaccaggctggtatcaaactcctgacctcaggtgatccgcctgcctaagcttcccacagtgctggaattacaggtgtaagccactgcacctagccaagtatctactttttgaataatccctttatatgtcccttttacaaagaaataataatttcatttttattcagttttacctctttttagtataaatacagtaagctttatatttgtgtttcattcacatgttatacaatatcgttttagcactagaaataggtcccaaaatggagactgggaatgttaacattagtaagaataaaaacatattggcacatttctctaacatttgaggttaaaacatatataatcatctggctaccagcagtagtcattggtcattttcctttgaccaatgaatcaaaagaaatgttttctggagaaacatttgaatatacctaagtagtttagagcttaaagttatgtttaacatttagatgagaagccagtagggtacagtggagaacaactcagatatcccaaatcttaccagcttgacaatattccctggcttctctgcaaatttgtttaaatggagttatgaggaatcaatacgattatttgtgcatatatccattataatatttggcacatattagatacataataaattcagttgaattgattctgggttatctcattatgtatcacagaatcaaatttttccaatatgtataaagttcattttcattaattatattacagcattatattttaagttcatctgcctttatttcagatttaattggacatgctcagaatgtaggcccttgatagtgtttaaatatccactattaatacctcaaaagactatatggcatcaataagtaacacaactcatacagcattatgaacatatgcctcaactaacatttaggtaccctatgaataaaatagcatatctagtaaatacaagaatcccatttgcctttcctcaaccaccaaaggaacagagaactgtttcacataaaagctcggaattaatgtttaagattcatcagtacctagcttgccttctctatttatatattagatgcttaaagtaaattagcactgtaaaaagtacagtttctctttggtttatcctttaattgagagcagaatgatatcgctttgcagatgttcccaatcttttgcatattcatttctctctcctccctcttggttaacgtgttccttttgtgtgactaatgcttgatgaaccccatttctaatcttcagttattccaccctcctcggtttttattcagattaggtggcagaattaaagggatgaatgatgattttctgctgtgattaaggtaaaaatacaattgcatctggaacaaatggatataaaatacctcagccatattggaaggcttctctaggcctcatttttcctccattagacattagcatttaggctatttgttttacagtgtcaagacttccagaagataccatcattacactacttagttatagatttagagaacagtgagcagtgataacctgttatgcttgcaaactgtcacttgggcatcttccattccttgactatgctcttcagtagattaatgtatctttctctttgtgaatagttgcaaccagagagtaaacatcatcattcccattactaaatcaattatcttgatcccaattccgtaccttcctctgagctcattcctttggagtcagttaacatcaaaaatgaatattgattaaacctcaagaggctatagagaaatacaagagattcatgtgaaatgagggaaggtgggattcagactattgttagtaagtatttcaaaaatggttgcatttattttttctaaactaatgtttgcaggttgaagtctgcacaatatatgcctgcgtgaaaagcaatggaacccaaattaccactgtggaagacactccaagtgatataccaacacccacaattcgtggcatcacttcaaggtacaaaattttgtgtcagttaaatctaaggaactctgatcagaagaaatgaaaataaaaatcaaaggtatcctctcagccatgacaatctcatttaatgggttattataagtatgtgtgtaaatcaaatttttgatattatttcacagatattaatcttcactggacatccaatggcatttaatctttaatttccctgattgcccagcctcagatttcttatttagtaacctgtaagcaaatacttgaaatacatgtctccttatttgaatgtgtcctttagtgaatccttttgcggagcataatacaagcttaattgtaatgactaccttctaacttaatctttttgaaaaaaaattgatttatatacatcagagtgccctaaagctagaaatctgtaaaattagtagggcagataatgtttagataagcattaccaattttgtcagcttcttggtagaatcactttatttttctttattcttttgttgctgagaaatgaccatagtttgaaagcgagtctctttataattcataattagtaacaacaacaataataataatatttggtattgtttccaaagctgaaaataagatggtaaattgttcatccgtttgtatcaagttgaggctgggaaaagaaatcttagtgctttcacattatactttttgcttaagccaaatgaatcacccttctcttacatgtgcaaacaacacacacacacacacagacacatacacacactgaaataataagtctattattaatgtttcaattctgaaggatttctctatgacatgttgaaatttctggatcttaaatcagttcaaaaaattagtactggttttggcaaccaatggttaaaataattagaaaaattcaactaacctgactgttagctgttcgtggcaataatcatatcttgtctgcttgagtatatcttctatcaaacacatgatagatactgatctaatttttggcatactaattagtttataatccccccagcagatatcccccaacctattcacagtattatctactatgcagggaggaaatagtcatattaaatgggcgttagagacctttattctttagcaaacacatctgtggctataataatatagaaggcaaggtggggcgtggtggctcacgcctgtaatcccagcactttgggaggccgaggcgggcggatcacaagctcaggagatcgagaccatcctggctaacatggtgaaaccctgtctctactaaaaatacaaaaaattagcagggcgtggtggggggcacctgtagtcccagctactcgggaggctgaggcaggagcatggcgtgaacctgggaggcggaacttggagtgagccgagatcacgccactgcactccagcctgggcgacagagtgatactctgtctcaaaaaaaaatatatatatatatatatatatattatatatatatatataatatatattatatatatataatatatattatatatataatatatattatatatatatatataatatatatacacacacacatagaaggcaaaagtaatacaaaagagcataagacatgattctaaatttgcaaagttccagtccactggggaagatactcccctaaataaatgtttatagaacaatgtaaaaaacactataataagaggtttagatgtgcaagaacataaagagaaaaatagcaaactttacccagaattatcagtgaaggcatcatggaagatgtgacctttgacttcagtcttgaaaagctcaaggaagaattatagttaggtgggtggatgttttcaaattcttgtctgctggcatccccatgactcaagcccatgtgaatgacgtaacagaatatgcctcatagtacatatttatttataactaaaaataacgtctaagctttataagaaatggaacaaatgtgactgtgtctctaggttttttttcctttaagaagattattgcacataataacagaggacaaatatttttagttgctattaaaaattgcttgtatccaaatacattaaattgatgacagaaacattaaaaagagtattatacaacaagaacaaggaaagtgagagaggagacaacaacagaaaagagattgcaacacaattttgtaagcaatatttgtcagaaagaagcaaatgatttaatacagtggagaaatttacaaccaaaatattggttgacaaaagacaataatgacaggaaacaaactgttttttccacagagaactggagaggctgagcacttagaagttttaaggatgtaaagaggaggagagagggtagggtttaaagctgaaatcatggggtgagacacaactgttaacaaataagtgtttggaatcccaggtctcttgcatctttgctgtgcatccaggggtctatttctcttcctccacatgacaaagtccaccgaccaggagattagacatttattctctggagaaactgagggctactaggcagaggggagctgagatgagacacagaagtaaaaacagtgataaagtgagactacaacctgaatggtgggctttttggctaagtttcccagttctgccctcaaaagcaagtagacaagtcataaacacctccagataggaaactgaacatagttttctagaaaaaaaagaatgatctcaaaaaaaatacctccagataatagcatatagggatccctaacagtaaaaacaacttgtcctctggtcacccagtagggaagtatgccaatcaacaaggctcacctaactataaagcttttagtcagctttttttttttttttttttttttttggtgcatcactcttaaagataaaaaggggaccaaaataaacaaaagacatgatacaatagattcagagataatgcaggtgaggaaaaaaaattatagcctcagacagataaaagaaaattctctaaccataaaacaaaaccagcatacttaaaaaaataaataaataaccaacgaggagaaaacttcatggaaattaaaagggtgaaaagctgaattgaaacttttgaagaaagttcaagggaatgtctctgaaaatgcaatgaaacacaaagatttaaaagagagagagacaaagaaaaaacaatagagagtatccaggaagtctaatatttgaataataagagcttcaaaagagaatcaaaggaaaagagggagaaaatttaaaaaaaaaaaagacaagaaagtatcccagaaccaatgtactactgtgcagatcaaaagattccctggataccaacaatatgactaaaaagtgattacatataaagggatattatcaggaaattgcagagtaccatgtttaaaaagcacatccaaaaagctgccaggaagaacagacactaccacaatcaggatgtgaagcagcatcatgatgtcggtctccattattgctaacccctcttctacccttcctaaaactaagcaaacactgccatgttttgttatgtataattctgccttttccatattgtcatgtaaatggatcacataatatgtagccattcaaatggcttcttttagttagcataatgcatttaagatttgtccatcttattatatacatactagcagttgtatacatactagtagttgtcagtttttgttgctgagtaagattccattatatgaaagttctacagtttgtgcacagtttggataattttcagttctccgtgaccacgattaaagttgctgtaaaacatctatatacaggtttttgtgtgaagatatattttcatttcatgtgggtaaatacccaggagttggattgctgagtcataaactgccagactgatttacaaagtgactgtaacatctttcattcctactagcattgtatgagagttcaagttgctctacatttttgctagaacatgagatactatgaggtgttttcctcttattttttaaatagtcattttaatagatgtttgtggtgtgttattatggtcttaaattacattttccctaatgactaatgatactgataagctttgcaattgctttttgcatgcactttggcatttgtttactctgggaaatggtatctccaaatcttttgcaaatttcttaattagattctttgttttcttattttttgagttttgaaaattttttaaatatattttggatttgagtttttgtcacatatgtgatttacagatatttcttctctaccttatgatttgttttcaattatcttatttgtgtgtttttaagagaaagagttttaactttccaagagagttagatttgttactttttccttgacagtttgtgcatctggtattttatctaagaactttttgcctgagttaaggtcacagagactttctcttgtctatttcctagaacatttgtatgtttacatgttgaatttatgtctatgattggttttgtgttaatttttgtatacactgaggcatgagtcaaggttaattttttttggcatgtaagtatttaatagtatcaacaaaatttttggaaagattatcttttctttattgaatatttttagatttttgtcaaaaatcaatttaaacacgttttgtaggccatttttggactctcttttatgttcaatttatcaatatgtatatctataccaatatcgcacaatcttgattactacagctctatagtaagctgtcaaatcacattgtatgagtcctccaactttgacctttataaaaatcattttggcctttctcactactttgcctgtccatataaatttcagaaacaggtcattgatatctacaaaacatgtgattttgattagaactgcattgaatttgtggatcaattggtagagaattgacatcttaacaatatcaaatgttctgattcaagaacacactcttgctcatttatttgcatcttctttcctttattttatcagtgttttatataatccagtatgcaaatactgcacatattttattaagtttatacctaattacttatttggggggtgctattattattgtttctttaaaacaaattcaaatccaattgttgctagtgtgtagaaacacaattaattttggaatagtgagcttacatccagcaaacttgctaaactccttgtaagtcttaagagcttttttgtaattccctagtctatatagatcttctacaaagagaaactgtttatttttttcatttccaatcagtatgtcttttatttctttttcctgccttattgcactggatagtttaataacgtgataagagcatatccttgacttgttcccaatctttgaaagaaaactttcagtcttttacccttagatgtgatgttacgtatgaaatttttggccatgccttttatcacgttgaagaacttactttttatttttaatttgctgacaattttcattataaatggacatggaaatttgtcacatgcttttttgacattttaaatttgtactatgatcgattatatttactgattttaaattattgaactagtttgtattcgctggataaccagaacttcgttgtgacatattttcttcttcatatattgggggatgcaatatactattatcttatagaaaatgttcatctgtgttcataaaatatattggactgtgtttgattttcttgtaatacctttgcctggattgggtatcatggtaatttctggtctcatactaacttgggaagcatttccttcttttctattttgtggaagagattgtacaaaagtgttattatttcttaaatcttggtaaaattcaccagtgaaacccatatttgcctggagtttttctttgatggaaggttttttaacttggaattcaattcccttaataatgtatgatatttggcaatttattctccagtgagtttagtcatcttgtgggtgcagaaaataggttaatttaatcaaatttgtcaaatttattagcaggaagttgtttgtagtatgtttgtactacaaacaacaatttgttgcaattgattttattctttcatttctgatattggtagtaagtgcccccgtttttctgttcagcctagagttttatcaattttgtagatcttttcaaagaaccatttttggctttatttattttctatatcatctacattgttttctattttccatttcagtgatttctgctctctattgttttcttccctcttgccttgctattgcttctctagtttcttaaagatgaaaactttcattattgatttgagacctttcttcttttctctcagtcctgcttcggtatgaagctcacaaattttgaaatgttgcattgcacttcatttattcaaaatatattttaatttctcttgagacttctttaacccatggattatttacaagggtattgtttaatttccaagtatttggggatttttcagataagtttctatctgagtttccagtttaattctattatgatctaagaacataattttagaattccaattcttttaaattagttacagttttttcagggcccagaatatgatctatcttagtgaatggatgtgcacttgaggagaaggtacagtctgttgttgtcagatagagtgttttgtaaatgtcaattagatcaagttgagtgataatggtgttcagatcatctatatacttactgattttctgcctgcttgttttatcagttattgtgagaatggtgttgaagtctccaaatgtcattgtggctttatctatttcttcttcagatctattagtctttccttcatgtactttgatgttttattattaagtgcatacatgtttaggattgttaatgtcttgataaactggctcttgtatcattatgtgataagcccttttacttcctgataatttccttgttcttaagtttattttgtctaatattaatatagccactccagctttcaattgcttagtgtaattctgggtgatttttcgattgattccttcacattttgaatattacgttataaaaatctgactcctgttaaaatcctttgaagaaagttagagttcttatttacttttttcagcaggttaccaactggttagcttcagactccaaattctgttttcctttgccagtgactacagtcagttcctattttttcataaagtagcataacaaagctataaactttgctttactactctgtgtctgcacaatggctaatttgggatttggctgtagaattatgtaatagttctgatctcaaaatcttcgctgtgctgcttgcataggctatgcatgtgaggcaaccataaatgtgcagcttggagttgagtcaggacttgcgttcgttcattcataaaattagcttctagctttcttctctctgaaatgtcccccatctttccagctcctttggacttccttccctggatttttggctagaatgatatgatttcttttgaaatgtttgcctcccagcctgcctccaaatttgcataactggagttgttcttaggcaatgaggtaagaggaattcgagaaaaaaaaataacaaggacttcccccacattctttggactatagaggccccatttcctgatttctctggacagaaagatttttccccccgttggggctttagattccaatttggccacagctgccgcagtgcagctccttggctctgatcatcctcggagcagggcccagcagaaagaagacaaaacaaaacaaaaatgggggttttccctatactctctggcttgcaaggcattttgttctagatactctagccggaaaaaatttactttctctaggattttgcttccctagttcacagtttcacactgatactgcccttgggttaaagatgggaagtaaaggagggggaaaaaaaatgggaaactcaccctgtaacattcattcttaaagttttgtctcccctcctgatcagccttattgttagcttttcagagtcctcaggtagttactttatataatttttgcagatactgagttgtaatcagtgggagagataagctgtaatgggcttattccatattggcctgcatgggaagtccccctccaccacagttttctttcttccaatgcctttggcaactttccttttcccccccagtcagaagcctagcaaaaacttgatagaaatcattcataaccaaatattggcatgtaaaatctttcctttcttaaaatgatccatagtagcagagtaacattttccaaaggcaagactctaatgagcaactataggctgccaagccattaatcaaaattataccaacaccaaagcagttagccttgtgtgtgtatggtattgtttgtgtaatttcattatacttctggcaatgtatacttgttagttatgtttctattttggttttaaaaaatctttcatattagcaacatgcaaaatgaaatgtgaaatccttccagaaaaacatcagcagacggggtctacttctctagcatttaaaataatttggtttctaagaagccatacatttcttagattctttgtttatttttggtgaaattcagaagtcagtaaaatttaactcatatatttcaataacatacagatagcataccagcctgtttgattatatgcgtgcagtgtaccaactcatctttgtctttggccttaacttatgccttgtttttgactacatcttcagcagtacaagcccttatgcatgtttttcctcttatatataaaccaaagattccatagcacacaaataatatagaagaatcaaatggacccttctagttttataagctgctgcttcagagacaagccctgtttctacattgcattttccatacttctcatattatcatcagctccttctatatcccaaaagaatactaactactgatcgataacccggacatgtctggccatggcctacatgtgccctgggtagttcatttatttgtcttggtggatttgctagagtggaatttaatcaatagctaattcattaattctggtcctcgagaatgtagagactgacctggatgaagataacgggctgggtctggctttgatagaaatatgacaaacactgcagctgacagcttcactaggtactgtgctatgaagtttagttatttattccccataaatggagacactaagaaaataacacaaacaagaaagatgttttattacattactgttagtattccaaaatgcatcatttccaggcatgaggctcaagggaaagtagagaaagaactcagatcatgtcttttaatgtctttaattggaaccatggcagttttttcacatccaaatcagtttggggatgtgttattgataaggagtgtgaggtataaagtcttcgtagcactcacaaataattgttttaagatttgcttctagatgctgaatgagatcaatgatattcttatacacaaactttgcagaaatctttctgataacagcataggttagatgtctctaaatgaatgctaaaccactatcgttattaatgaatatctatatatttttttcttttttgttgttgttgttgagacaggatctcgttctgtcacccaagctggagtgcagctcactgcagccttgaccttccaggctcaagcaatacttcctcagcctcctgagtagctgggacaataggcatatgccaccacacccagctaatacatttttaaaattattttgtagagttggggtctcactgtgtcgcccaggctggtctttcgaactcctgggctcaagtcatcctcccgccttggcctcctaaattgctggtattacagatgtgacccacacagcacccggcatccccctatatttttaaattacttaatgtggggttaagtatggttcaagaggtcagagcttgtggagaaagaggattctccttttttcctcaccaaattttatgagacatgctatgatatactttttatgctatgacattagatatcagggaatctcttctatccttgattttttctgcctaacttttctcagtgaatgatagcttcaactgaagtaatgattttacagttttgtaaaattaaaagaaaaaattaatattttacatttaatttaattatttaacattacaagaaaaaattaaggccacatttctgtttgtttgctttaatagggagagtgttgggctgaaggatacagaatgtcaaatcacttgttttcacctgtataccaaacttgcttaccaatatgggcaattgtagactatttttaatatggactaaaactgtctgcttaaacctttaaaggatatgggtagaaccttgaaagagagaatttggactacactaagtgcaattcgtacagatccaatcaatagccttatggtcaccatggcttttaggaaatattactcatttgatggccatgagttctgattatcacattctgtttaaggagaccttaatagaatagtgtcagaatatagaatgtaaacagaaagacagaatatatagaaaagagaatattgggcttattattatggctctgctatcactattttcatttccttacctccctcttcttcccaaactcctcctaacttctttacctcttgtagctcccatagaaacagctcggtcgctgaagtagcctttgagtgcctttcagcaaaatccagttcttcctcctaattcactttagccctcaactgccactttgtccctggttctctaaacattcattgttttgttttgtttttattggttccattaaaaacccacttatgcattctgggtgtcctcaggaaaaagactccctaccttgctcaggtagttcagtcttgcaattttaagccatactgatgtctcaaagatctctggccctgttttcttcctaaactctaatcccacatacccacttgcctattgattttatgtcatgatattcacccatcacttccataaccatgagattcacaagttaattcttatctaactcatcatcttttccaacactcacttctgcaaatgtaccaccatcctgcatattatcgaggacatatatctttgaagtatttttaatcccctaagtttattaaacactgattttagtacattttctgttggagcatcttctcatatatgttactcttctccatttccaccactaccaccctggttcatgttttcatcgtttaagtttatataaccattttatggagctgtcttaatccaattagatacaaagagaaaaaaaaatcctttacttttcacctgctacttactgccttaaacacactgttttggctatccttccctcaattctcaaataccccacaggaacatcttatgggtttccaattatttttagttatgagtctcactttgataattaagattcatgatcaagtattaaaaagtccattccatcaccatcaaaatattagcctcgcatctagttcaaagattctatcatttctaaagctcaggcctaattgtagcttgctcttttcttccctcttactctttctttcctattccattttatccaaatatgttccctttcaattttattacttcactgccatcactgtttgacaatcacagctctccattggcaagtgatgctttcttgggcaattgtatgtttttcttgagaggtcctcatgagaatctttgaatagccaaattccctcacacgagtgttgccctttatagctgatcacttgtggtgccaaaagagcagaacattccaaagactcttcctgctggagtctcctcatgccagaaggccactgtcctgggccatgtaccttcaagttagctcaaacctagccatcttgcaaggcatccacttggctcttgagaaactcatccatctatgccatgctatagatcaatattgtggtattctaggcttaacctttcattgcagaactgctctggccaatctctggccactagaattctctaactgagaagtaagctttatttcctatgctcatacagactgccaaatttaagagttccctgtcaagctgtcccaagatctcttcaccacattttcctccaaggacaaaaggagggaaatgtgtgttcctttttattaaaagaacatgggttttgcattttgactttttacctactacaatttataataaacatctcagtaggataattaaatattcagtgacttgacttgaaagcaaagaattaaatttgtcatattacatttatttcatctttgttaaaagtgttctgatcatttttgataaccatgatctggaataatattgaagaacttgagtgttacataaatgattgacaaaaatgaccaaatcgattagaaaaaaagcctgtgtaaacataaccagataatctagagctatttaatccataacaatttaggttaatatcttagagtgtatgaagatttcttttctctggtcaaacaaaaatgttttgaaaaaattggggaaaaatattagaatgaaatgttaaagaatagtaatgtgaacctgtcttcataaaaatttgatctgacttgtatcattttgatattcacctgtgtaaaggtaagtgatatcaaattattttccctacactcctttgtatcttcaatggtattttgtacttcaagggacaactggaagtgatgagatctggggagggtgaaatgcatctgtaatcctaactagttgggaggctgagtcagaattgcttgaggccaggatttgagtccagcctgagcaacatagcaagatcccatctctaaaaataaataaagaagaaagtgatgacaactgtgggggtggcacaatagtatgtagtagtaacagtaataaaatagtaattctgctgacaatatgacataattaaaaagaaataactacaactagaatgtctgaacacttgatgaattcatgtaccaaaatatgtgtaaagaacttccagttccaaaatgatgacatagaagcaagctggcttcactcctctccacagaaaacagaaacaaatgtacagaactgagattatcacagcaatatcccagaactcaaatatgaggacaagacagttcccaaagtcacagagaagtgaaaatctccgagcagatggtaagaaaattggactttcatatccacaatgcccatctccccaatatattcagcaccacgcttgtggaaaatattttcctgacccttgatttctgcactggaaaagtgcgattgaagtggacagtttcccgaccgtcttaggttacctggcaggagacctttacctgcctcaacccacaggaagcatcaggagtgcccgaagggctctatctctgtgaggacatccagagacaatgtggggagatgggactaccatcaccagccctggaaattctgctctgtaactcagtaaaaggagatgccaaatcagagtggctgttcagcagcaccacactgtagtagttttgctccacaggtttcctgggcaccaatcctcagccagcctcctcacactaccaggatatcccctttggaacctcccctatttgggaaaggtggtattctgatagtttactggagacaaggcaaacctggacctgaggcaccatctagtgccaaaaaggaggcagtgacccagtgaattaaaaaaaatgaaagaaaatgaacagaaaaattacaaagaatctctatgcaaacatacctaagaaaaaccaaagcaagccagagaagactgcaataaataactaatccttcaatgcaaagacatagacatatatccataagaaatggagagaagagtaatatatgagaggatgctccaaaagaaaatatactaaagttgctgtttaataaattcagggaattaaaaataattcaaagatacatatccttgataatatgcaggacggtggtgtgtttgcagacatacaacttctttaaacagggaagtaggatcttctcaagctgacaaaagcaaggaaacagtgagtgaccctaacaagatggtgataggtgaactctatgaccaagaattcaaacagttttaaggaaactcatgatcaccaagatagtacataagataaattcagacatttctcaacagatttaacaaagagattaaaatggttcaagaaattaaaaaagaaatcttggatctgagaaatacatctgctgaagtgaaaaattcattagaggctctcaatagcaaactagatcagaggaaagcatcaacaaacttgagacaggctatttgaaaatacagagaggtggggataaaagaatgaaaacaagtgaagatcacctacaaggtatatagaaaactacctgaaaagacaaaatctaggaattattggtgttcaagaggaaggtaaacaagagcaagaggtagaaagctttttaaaagaaagattaacagaaaactttgtaaaatgtaagaaacagagaaatatccagatatagaaaggtcagagaagaccagatttgattaaaataagattattccaaggcatataacaatcaaattcttaaaggtcagtgacaaagagaggatcctaaaagcagcaagagaaaagaagcaaataacatatttaaaagcttcagtttgtttggcaacagtctactcaacagaaaccatacaagctaggaggaagtgggatgacattttcaaagtgctgaaataaaaaaacaaatgccatataaaagtactgcatacaataaagctatccttcaaatatgaaagagaaatgaagtccttcccagataaaaagctgaagtaatttaccactatgagacccatcttataagaaatactaaagagagttcttcaaactgcaagacataaaaaactaatgcacagaaagaaaacatttgaaagtaaacccactgataaattaagtacacagacaaacccagaatactctaatactgtaattgcagcatgcaatccactcatcacttcagtatgaagcccaaaagacaaatttatcaaaaacaatagtaggtacagcaacgtgttaagagatagacaacataaaaatatacaaattgagacgacataaagtcaaaatatggagaaatacagttaaattttagagttttttcattgtttctttgtttttggcaaccaagtacaataaccatatgatcatttcaatagatgctgaaaaagcatttgataaaattcaatatggctttattataaagtccctcaagaaactggatatagaaggtgcatacatcaaaataaaagccatgtatgacaaacctatggctaacattgtactgaactgggaaaaaatgaaagtctttcctggaagaactggaacaagacaaggatacccacttacacttttattcaacacaatactggaaatcctggtgaggcaatttgtcaagagaagaaataaagggcatccaaatcggaaagggataagtcaaattagccttgttaacagatgacatgctcttataattagaaaacctaaagactccaccaaaaaacctgttagaactgatgaacaaatttagtaaagttgcagaatacaaactcaatgtacagaaatcaatagcagttatatacaccaacagcaagcaatctgaaaagaaatcaagaaagtggtcccattaacaatagctacaaagaatataaaatacctaggaatcaatttaactaaaggagtaaaatatctatacaagtaaaactataaaatgctgatgaaagaaattgagtaagatacaaataaatggaaagatattccatgctcttggattagaagaattaatattattaaaatgacaattttacccaaagtaatttacagattcaatgtaatacatatcaaaagaccaattacattcttcacagaaatagaaaagtatttctaaaatttatatggaaccacaaaacacccagaatagctgaagcaatctgagtaaaaaaaagacaaagctggaggcattacactaccttacttcaaaatatagcacaaacctaaagaaaccaaatcaacatggtattggcataaaaacaaacacataaaccaatggaatagaatagagaacccagatataaatccatgcatttacagacaactcatttttaacaaaggaaccaagaacttgcaatgaggaaacagtctttttaataaatggcactgggaaaactagatatccatatgcagaagaatgatagaagagacagaagagatagacccctatctcttaccgcattcaagaatcaactcaaaatggattaaatacttaagtctgagacctgaaactgtaaaaccaatagaagaaagcattggggagatgctcccagacatgatctaggcaaaggcatttgtgtaagatctcaaaaacactggcaagagaagcaaaaacagaaaaatgggattacatcaggctaaaaagcttctgcacaacaaaggaaacaatcaacaaagtgaatagacatgccatagaatgggagaaaatacttgcaaactgtctatctgacaatgaattaataactgggatatataaatagcttaaacaactcaaaagcaaaaaacaaaaacaaaacatctgattaaaaatgggaaaatgatctgaataggcatttatattgcctattgcctattcagaagacatacaaatggccaacaggtatatgaaaaaatgttcatcatcactaaagagatgagaattgcaactcaaaaccataatgaaatattatgtcacccagataaaatggctttgataaaataaaaaagcaggaaataatggatgctggtgaagatgtggagaaaggggaactctatttacactgttggtgggaatgtaaatttgtacagccactatagaatattgtatgggggttcctcatgaaactaaaaattgaactactgtataatgtagcaattcactactgggtgtatatccaaaagaaaggaaaacaatatattgaaaagacacctgtactcccatgtttattgcagtgctgttcacagtagccaaaatatgaaatcaacctaagtgcccatcatgaatgaatggataaagaaaatgtggtacatatacacaatggactcttattcagccataaaaaagacttaactcctattatttacagcaacatggatggaactggaggtcattatgttaagtaaaataagtcaggcatagaaagacaaacattgcatgttctctttcatatgtgggagataaaaaagtgaacctcatgaaggtagagagtagattggtgattaccagaggcctgagagggtcatggggagagggagaggaagaatagattgattaatggatataaatttacagtttcaatgaagagataagacctagtatttgatagatcagtaaggtgatttatagtttacaatatcttttacatatttcacaataggtagaagggaataatttaaatgttgttagcataaagaaaagacaactatttaaggtgatggatatgccagttacattgatttgctctttacaaattatatgaatgtattaaattctcacatggaccctgaaatatgtacatctattatgtattgattaaaatatatttttttaaactccaggcttccccaagattgtaatccacctgtaatttaactgactgctagtaaagcctgttactttcagaggaaaacaattcaacctagagactttgcaaagtataatccacaatgttgtgtgtatgtgggctgtgtgtgtgtgtgaaggaatgagaaaatgtaacccaaacatttgagagagaaaaaaatgtgtgtagacatggtgacttttatcagaagttgtattaaggtatcttaaatttcagttcctattactttaaaatctaaaaaaaactataacagttatttcatgaacaaatctaccaaaaaaaattcattcaaatatttgcaatctgtttatgtttatgcatgagtgcccaaaagtatcttcagctctttttctccaatatttaacatttattcctgggattgaagaatgttccttctattttactcttaaacatcaaagcaatgaaactattaatcccgctaataatgatgcatatttctcaaagatgcctttcattttcagatcagcaaccaaaggagtttcaattgtctctccagttggctctaatgagagatgtacagatgttaaacccaatactcttcttaatcattttccttcgtgtacttgattaaatcctcaaaagcaaactgttcatgttcttgccgaaaatataggcggtctcacttaacagttatgttgcacaagaaagggaagttataatggcatggaacgtgctctacgtggtattttctagactttactagttcacgagcttttgtggataagtcaaactcttgaatgtcacttaaatgtaatcttttctgtagttgattatgcagagaatacaaaaggtatctgcagaatgtggaattaattttgaaagtttgataaaaacttcagaataatagctgtggctgtacaagtcatctatgaaactgttctctcataggtgacattaatttcctatctacagagttttattactgaatgtgttatgtttgtacccccacaaaactgaaataatagttttctttttttagcagtctatgaaaatgttgaggtttatcttgactgccgctttttaacataaatatttgggcttcattgaattcctaatatgtgatgtcacttggaattctgatagggtccagtaatttggcctgcaaagacatattttaccttaaaatgaaagggatagttgaaatgttattttacacgatagcaaaaaagcatccaacataagttgtgagatttttattgcttaacttttgaaatagaaggacaaggttcttatgtgcttgctttattccaaagtatatatgggaatgctaatgctttatatgtaaaatgtacgctacacatatttgtgattagttaatttttatggctagaaattctagaatcataaaaaagaactaatcttgaatgtcagagcttcacctatttttttaaaaacaatgagaacaaaaaaatcattataatttttatatttaccttgtgtttcacaaaaaggaggttttctttgctgtgctacactgcaagaatatgtcatgttcaaatctctggggctttattaaaaactttaactactgtcttcttatagagattattaagcaaatactaaagatagcatagatgtgtggtctaggcagtatttttctggcaagtagacctaagtgcagaatttaagttctgtaacattaacctgagactaaatcattttattcagggttgtctcctctgtgaacagctttatgttatgacctcatttgctacagcaaatgaaatattaatagatcattgaaaatgcagtaaagttttgatcagatgttataccttcattgtataccaaaccctgcctctcataaaaactttctacttgggtttaaattgaaattatcactcaattttttaaaatcaaacattttctttaagaacatgacaatgtaaacatatttcttacgggaatctttaagttctatatttttcaccaaaaatcatttcagaccatgctagttaaagagttattgaaaaaaaaaagaatctatttagatgagtcaaaaaattaagcaaagtatgttttaaataagttagtgactataaaatttctcaatttgggcatttattttgactgcaagtaacaaaacacctgacaaaagagacttaagtaaatagctctagatatatagttgactcttgaacaatgcaagggttaggactgctgatccccacccagtcgaaaatctgcatataacttttgactgtcccaaaatttaactactaatagcctactgttgaccagaagccttaatgataacataaaaaactgattaaaacatagtttgcatatatatttatactatattcttaccataagtaagctaaagaaaagaaaatctcattaagaaaatcataaggaagagaaaatatatttactattcattaagtggaagtggatcatcataaaagtattcatcctcattatcattatattgagtaagctaagtaggagaagaaagaggaaaggttggccttgctgtctcataagtggcagaggtggaagaaaatctacatgtaagtggatctgcacagttcaaatttattttgttcaagagtccgctgtggatagttgttggcattggtgaaccaatgccaaatataatggcggcatctttgtgattgttttggccttttcaaataactgaaagatgattgctgaagttgtagacatcatgtttagcggaaagaaagagaaaaggagaaggtggcagctctttcaagaaagctaaaatttcctaggaacctccataggagtcccatcatggtgttcccgtggcatctctgagcagttatgtttcatatcacaactcctaggtaaagtaaggcaaaggagaagcaggttagaagtaggcattaagttgccacatgttctaattgtcaccttgtttaccaagtcatgtatgtcttatctttgcttaccaaacaaaatgctctgattttcttgattagccatagtgacacttgcttcttgtctttgaaactgaaagtaataaaccacctcacgccatgtgttattcttccaaaagctaacataattttgattgatttgaaaatatatgatttcatatataaacatatataattatatatatatattagtatctattgctgccactttttacttaagactgatagcatcaatgttaaatagtgtcttttcagaagtattgattattctctctgttgcagatctcttcaaattgattgggtgtctccacggaagccaaatggcatcattcttggatatgatctcctatggaaaacatggtatccatgcgctaaaactcaaaagttagtgcaggatcagagtgatgagctctgcaaggcagtgaggtgtcaaaaacctgaatctatctgtggacacatttgctattcttctgaagctaaggtaagtcttttctaactaatcagtgaaccatgtttttctcactcaagactccaagtgaaattattagcttctcacaccatgatgtattatgatcaatatttccactactctatgaagaagactccacggaaaagaaaggatgcttacaaaaatcactatcaccctcatgagcactttagccttcccattttttattatcttcacaagaaatataaacttattagaatagggtacatcccaaattttatttgattgagtgacttaaaattttctttacaacagatcttttcagctacaaataggtgtttgtttatatggcactgatgagtaactgtgaggaggacattttatgatttgtcagaaatattttagcattatagtcatttgtagattaatgttcatattagatgcggtttagaaatcagatcaataatacagccagacagaggagtttgtaaatgacttttattgacaaacaacacaaaatccttagtttgaaggtagaattttatataatgaaataatgttcctatttggcaacaacagcatcacacattcaatggctaaagctactactaaatttataagatttactgcaaaagaacaccataattaagaaagtgagttactgaagcaatatggatcaaaatacaaattattatggctgacacaaatttagcaggagttatcatctaagaaatgcataaagccagcagttactaactgtgcattttttgatacttagactctaaaattatcattatgcctacatttgacatcattttatgccattaagtatgcacatatttaaatacacacatctgatgaacatatttgtataaaattaaatttgggatttctgagaagaaaaatactaaaataaatttgcccattaaacatatcctccacttaagaaaaacttgggaaaatgttggcaaaatacggaattcacttctcaatttttttctttgcttctattattttaatatttattatctgttacgaagtggacaaagagagaatagttgtataggcatacgaataaatgatttaaagtttgtggagtgcagaaaacaatgtgttccatcaaagtaaaaactgattctggccagaaactgtcatagtagtttaggtgtgtataatggatttgataagtttcaaccctataactttagtggcaaaatcaaagctaagtagagtaaaactagtaaagataatgtttccatttaagtttattctaaaagatcaaaaggtggatgttcttaaaatgttcatattaaattagaatatacctgagatagggtgaagaaaaagtaatgggatgaagaaaaatattaataaagtattaacagaataatatttacctatgtttaggctaaattatttataaaattactcctacctttctttatgctgtgatttcagaaaccgctttttgtaacttttaaaaatttactgaagctttgtaccaaataagtgactggttggtgtaacattcctaaattcagtgaatgacaaagaaccggttagtttaattttaaatcaatttaaaaatgatttagacaaatctactctacaaaaaaaaaaaaatcatacgggtcaccttttatagaaaataaatgtaaattgatgaatagggaagcaaaagttaggctttagaaaacaggcgtgtgcaaatctcaccacatagtcttgaaaagaaacatcacatttggttattcttataatgcaaatgtcataccttattacactaaaacgagacacactatttaatgatgccttaaacaaagtcttatttttattgttgagcttaaagaggcaacacaggtattgcggtaaaagagaataaaggatgtcagttaaatttcaaaaaaaaaattgtaaagttcagtttgggactaggtactaatacacatttcctagcatgaaagattggagagaagtagaaaagagacttgtattgcgggtttaaaagctttttggctaaatcactgtaaacatcaatgtttcccaaaatacttaaacaagctttaccataagattacagccatggttcacaaatcccagtgaacgtaagacctgggggaattgttaaaacctaggatttcatagctctagtcccagagattctgattcagtaggtttagatttggctgtgaaaatttgcatttctaaacatgttcccaggtgtcttagttcgttttcacagtgctataaagaattacctgagactgggtaatttatgaagaaaagaggtttgactcacagttctgcagacttaacaggaagcatgactgggaggcctcaggaaacttacaatcatggcggaaggtgaaggggaagcaaggaccttcttcatgtgatggcaggagggagagagagcgaaggggagagctgccacactcttttaaaccatcaaatctcgtgagaactcactcgcctttagacctacaataaaagtctctttcctacttctctccaatctttcatgctagaaaatatatattcatacctagccccaaatgaaatttacaattttttaaatttaattaacttcttctgttgtctttcactgcaatacctgtgttgcctctttaatcccaacaataagactttgtttaaggcattattaaaattttatataataaaaaatgtatatatttaaatatatctatttttattataaaattttatataataaaagatctatatcttatgtatatatacatatgtgtatgtgtaagatataagatatacatcttatatcttttattatataaaattaaaattttatataataaaataaaagatataaaattaaaattttatataattaaatacatattatattatatagtattataatagagcacaaagcatggttgaagacttcaaaaaagctgcattctatcaaataacatttataaaattcgaatgatcctggaaaatacatttttaaaccaacgaaatatgagtaatatggtctcagatcttctatgccttacaagaaaataattatattacatgagatacagtggtataacactcttaactaaactgatatttctttaaaactgttttcaaactttcaggtttgttgtaacggagtgctctataaccccaagcctggacatcgctgttgtgaagaaaagtatatcccgtttgttctgaattctactggagtttgttgtggtggccgaatacaggaggcacaaccaaatcatcagtgctgctctgggtattacgctagaattctaccaggtgagggttatttccaggtgtactcaaaaactatgggaacctgaaaacataaacacgtggttcatgtcagtgaactatttcaaacacctccctctcaacaaaaattgaaccataaacacatagccaatggcctgctctaaatattgtttcttccttctgctttgttaaaatataagcaaggctaaatattagaaaacgagagaacagaaggaatttacaatatctactacagaaagaaataaatctggagatctggctaactccttttatcttgtggctttttttattaacatgactatatattttcactattaaatatgtgaattgctgactgttccaccccatgaagctgttccccacttcctccatttctaatctgaactacacatgcattgttcttggatagatcgcaactgcaaatttcatttgtctgagaattctaggccactggcaatattctctcatcataagtcaggcaagggaaggaagaatgctgcaaagggtagcaaactggattttttccttcatccctttttagtattagccaacttagctagccattttgctccaaatttcaactacataaaacaatgcctagtgaatataattgggaatgatgctaataataactgccatttttaaagtaccaagtctctcgcaggctctgtattgaagactttacatgggataccttatagaatcttcacaactccaggaaatttgtattatacaaggcagtttacaagtaaggaaactgttttagagaggatcaataacatatccagattcacagatgtgcatagaagtgaaagaactaaaatgtgaatataagtatgtctctcctaaatctatgctcttttgtgtactttactgcctctttaaccaaaaagcatcaacctcttttgacaatttttttaaaaggactatttaagacttctaaacttcttcattactaccactgtcagttacaatttatcctgcaaaagtaattgagaatacaaaagtaattgagaatacaaacttttttctactacttaagtttgatactgatatcttctttaaagagcaggaaatggatataggagaaagacaagaaagccaagttttttggaggccataggaaagctgaatactttgagatatctagtttagggtgaaatttatgcccaacgtctggttcctgtaaattatgttcagtataactatatccatccaaggcatgtgaaatgagacactgtctaacccagtgtctgttttgcaaaatactggagcaaatatagaaggcgtgcaatcacctgatgggttcatcttgcccattgcacagatagagccaatttaccaaaacagtggtattgcaacagagaaagagcttaataaatgcagagccagctaagcagaacaggaggttttactcaaaacagtctcccagaaaattcaaaacctagggtctgtctgggcacggtggctcatgcctgtaatcccagcactttgggaggctgaggcgggtggatcacctgaagtcgggagatcaagaccagcctggccaacatggctaaaccccatctcttgtaaaaaatacaaaaaattaactgggcgtgtggcaggctcctgtaatcccagcttctcgggaggctgaagcaggagaattgcttgaatctgggaggcagaggttgcggtgagccgagatggtgccactgcactccaacctgggcaacagagtaagactctgtctcaaaaaaaaaaaaaaaaaaaaaccctaggggtttttttggttggttttttgtttgtttttgttttttgtttgtttttttatttgtttgtttgttttgagatggagttttgctcttgttgcccaggctggagtgcaatggcgtgatctccggctcactgcaacctccacctcccaggttcaagcgattctcctgcctcagcctcccaagtagctggaattacaggcatgtgccaccacacccggctaattttgtattttcagtagagacaggctttctccatgttggtcagggtggtctcgaactcccaacctcaaatgtctgcccaccttggcctcccaaagtgctgggattacaggtgtgagacaccacacctggcccagcctagggttttttttaggatagtgcagtaggcatagggctagggaatgaggaatgcttattggttggggataaaattatagggagtcagagctgtcttcttgtccttagtcagttcctggatggggactataggatcagatgagccagtttactggtctgggtgatactagctggtccctcagaataaagagtgtgaaaaatagctggtccctcagaataaagagtgtgaaaaatacgttgaacaccaatcttaggttttacaatagtgatgttatctatggaagcagttgggaaggttaggaatcatgtggcctctggtgccatgaacacctaagccgtagttccttgtggctaatttgttaattttataaaggtgctctgccccccaagcaaggagcaagtttgtttcaggaaaggactatcatcagtgtttcgaagttaaactaaacacctctcatagttatcttggcctatgcccaggaatggacagggtagcttgtaggctagaagcaagatggaattggttaggtcacatttctttcactgtcataattttccagtgtcaggattttcttactgtcataatttttgcaaaggtggtttcaggtgtcctgattaaatactgctcaagttttctcaaggcagagaaccttcactcattatttttccttataattaatagaaaaaaaaagtttgtatagcagtgctgttatttcttattctctatcaaaaatatttcaaaattgaataagttctagtaaaccagattttccacttaagaaaaagtaaaaatatatatggaaataaggattttgtagaaaactgttaaacttcttcatactacagctcacgatgtcaacaatggatcaaatactgttaaatgctttactttctcgaagtaacttaaatttggggagttttcatgtatgattcatatctgcccttgattacaaatcattgctataaaattataattacagtgatcagatggacgttttgtgttgttcaattcctaccattcttcacaccagtagaccaagttgatcatggaactaagtaatagtgttttcatttccacatcacattaaaatttttatgttatgatttgcaacaaactattcaaactctacaaaatatcctctgtcccttaaaactaatgaaaaattcttagttacatcttcactgctgctaactcaggagactggcctgtgactttctcaatgctaacataagtagtcagattttgaaccgacagcacaatctacttttgttaggtttcaaaataaaatttaacatttttcttaaaaatgaaataactcatggaagctcagaagttgtcattgatattatataagcctttaataattaatttttagaccaaggatttaaaaaatatgtattgtctgtatgtataaatacatgtttctgcacacctaaagcattttaatatctaccaaaccattgagcatgccccaaattttgattcttttttaaatagttcatttttcatagcattagaatgcataccctggtgtcaagaaaaaaggaaaaaagcaatctcatgaaataatcaaagagtgttttgctccaatcattaatcccactgtacctaaatgaagagattattttgtgacctctgtcctcagccccgtggtctttgttagctagtttaacactggttacactgagggggaaaaaagcgcaatggtcccaaatcctgttgcatctaaatgtgatttaaatctggtcactagtctgccagttcaaggccaagatgggtataggcattttgatatttatggattagcctgaaatattggtaaatacgtactttattttttttctcatgactttcttccataacaccccataacaaacagcagaagaggaaagaatgctcatttctctcccttttttaataaatatgctaataaccccaagtaaatgttaatgtgggtcattctttgataagaataacaattaactgttagactgcatggtagtttttagagagaaaacattttcaagcctggcctgaaatagattcattttgagaggttaatgagaaggtgactgatccttgtatcttatgtctaatagcccctttttgaggaaaaaaaaatagttttattttttattgatataatccacatctttttttttttgaagacttttcttctgtcagtaactaaataagattctgagggattcagaaagacatagctaaaatatctaaaccaattaacatttattatgctcaaaagaggctttaaaaaaaagtattggctttcgccatgtagatgtgtatactatgtttcctctaagctcaccattgtcctgagtggtgtttaattaactgttgttgccctgtaccatgggatacattatcttaaagtttaccatagagggacattatgttctttgactgtgaagacaaaaaatatggcaactacatttcagacgaaatagaattattttacccaggggaagataacaaatacagtaactttactgtttacaataagctcgttgctccttcattggtctctggtagcatcatcatggaaacttttactaagttccctttttcttagagataccatattataggatcctttcaaagataattgactaagccaactgtctcctgaattctagaaattcatattttgagaaaatcctgagtatgtcttgatccggtcctggatatttaccctagagaaaagcaaatttatgtttacacaaaaacctgtacatgagggtttacagcagctgtaatcattactgccaaaacctggaaacaattcaaatgtccctaagtgagtaaatggacaaatgtggaacaaaggaatactatgtagcaataaaaaagaacaaagtattgataagtgccaagaagatatcaagcccagtgaaagaagccagtctcaaaaagctaccaactgtgagactgcatttacatgacatactatacaagacaaaccatagttttggagaaaaaagttgacaattgccaagggtaatggatgggaagggaatgtgactatacagggatagcgtgagggtgttctgtgggggtgatgaaactcttttgtatcctgatggtgtttcttcattaaaattcatggaagtgtgcacccaaaaaaactaatggtcctgaataatatttttaaatgaaatatttttaaaacactatttccattttacacataggaaaaatgggacatagaaacatgaccaagacactcagctagtcaaaataggaattttcatggttaaattttaggttgagctcctagagatggtgtgttttataataatgtgatgactgtgtatgagtgacttaatatatttttctcatatgttagtagaacagtaagatagcaaatatatttccattaaaattacaatgaacatccctatctttaaaagaaagcaaaaatgtcttagtcagtgatgactatttcaagtaatattttacatgatcacattcttatgaaagcataagttttgtgtagtgtttccgtggtttgatgctgaataattagtgaataagatattggttctggagtcaaactgcctggctccatatcccatttctttcacctcttagttgtttgaccttcattaagtaactttaggaatattagcagggtattaatgtttctgatgtccattgggctgctgagttagaatactcaaagctaaccctatcttttatatctaaatagaaaaaaaatgtttagtaattgaggagcatatgagtaaagagggctaacaggcctcctttaaatgacaaagtttctaatgaatctttccagagcaaggactcaggggtgtccactttcatcagatcatgtaaagggatagccagttcccaaaagctaagattcaaacatctaatgacctttgagatcctatgaaacaaaggatccttgttgatcctatgaggccaagcaattctctaagttgacttttagcaactagccagggaaagtcatgaagagcttccaaactttgaagagaaaaagactttccattttgcaaaatgtcacagcctagaatttaggtcctagaaaaagcattttgttctgacaaaattgacatttagagactttatgtcgattgtatgctaccactattgacaaatagagggaatcaatttttcaagtctatctggagaacgtgacagatgatcattcacatattgcacaacagttgaatcttataggggaaattaaatatcgctcagtttgtttcctattgctgctataaatcatgaccagacacttcgtggcttaaaaccacacaaacttactttatacatccaaatatcaaaagtttgaaatgggtctcattgaactaaaactaagaagttaacaagagctgcattcccttctggaggagagaatccattttcttgccttttccaccttgcagaggctgctcacattctttggcttgtggaccccttccattttccaggccagcaatgaccagttgagcctttctcacttcatattattaaacttaatcacatctgttgtcttcattcccctttgccatgtaacataacatagtcacaggttccagggattaggatgtggacatcttagggaggccatgttgtgcttaccatggtaaggtaatggttaagcagttgtgagaattaagaaagcattgtcgtaaactcttggggaataactgtcacaagtgaaacaaaaaaagatactgtgagcctgagtgcaagaatatatgaaaaaaatgctaagtatagatttgctataaattaagcagctgcctcagggagtggcagtaggatgatattagggttgggaactacagggaaatgggggagtgcaatcttgttaatgacacttaaatcttgtacaaagtggtacacaagtcttttatcattttgatagagtgaacagtgaactacaaggactggtacaggggataatggggtgttatgccaagcgaggtaactttctagaggtatgtagatacaatggaccaagttattaaatattgttctttttagtagattttgggacagtttcaagaaatgcatagccagattgatagacatctttaaggggttagcatcctgtatgaatcccacatctgagcagtttttgccccagaggatcttggagacacattcaaagtcagagatgttgataacaaaggcatcaggtaattagctggtgctaccaccaaattataggccaggcattcttctcctgggagttacagaaagagactttcaggtgcacatttaatgctggtatctcatttacaaagtggatctcttctcaacagatgcactgaagtggaattactaaacaaaaaatatgttgattcaagagaaagaaaagaaaaataaaggcagaatctgaaaattatttgatatgtgtaccgctgagacatttggttattcctagaaagggataatggaaaattagaagggtttttgatagataatatacctaccaccagtatcaatcttctatttttacaattgcatagaaatttctcactttctatgtcaagggcagttatggatagatgagagcagctactttcacagagaggtgctgttttgtcagtttgtccttttttttttttttttttgattgtgtctttctaagatacactaataaaggcaaagtaggtgttctcccagtgtcccttacaatattgaaagttgtttttgtgcagactagacatagaggtgccctcattcttggctttatctaattgcttaatcccaaaagctgttaatgtggtctgaattttttttctttttttctgagccaaagtatcttctaagtgcttagcaagctcttgtaatttagaaggaagggacaatctactgtcttatcttctgttttatgggaagttatgataccttcttcactgatctttagagtattctggaaggtggtagttaagtgatctctgaagccaggcatggatttattttttccttgtttacaggacttttttgtggtaaagtatacaccacataaaatttatcattttaaccattttttaagcacacaattcagtggcattgagtgcatttgcattgttgtacaatcattaccaccatccatctctagagctcttttatcttctcaagctcagactctgtttccattaagcactaactttccactccctgttatcttcaacccctggaaaccaccattctgtttttggtctctatgaatttgactactctaggtacctaatataattggaatcatacaatatttgtctttttgtgtctggcttatttcacttagtgcattttctttcttttttttttattatactttaagttttagggtacatgtgcacaacgtgcaggttagttacatatatatacatgtgccatgttggtatgttgcacccattaactcgtcatttaacattaggtatatctcctaatcctatccctcccccatctccccaccccacaacaggcccctgtgtgtaatgttccccttcctgtgtccatgtgttctcattgttcaattcccacctatgagtgacaacatacggtgtttggttctttgtccttgcgatagtttgccgagaatgacggtttccagcttcatccatgtccctacaaagaacatgaactcatcattttttatggctgcatagtattccatggtgtatatgtgccacattttcttaatcctgtctatcattgttggacatttgggttggttccaagtctttgctattgtgaatagtgccgcaataaacatacgtgtgcatgtgtctttatagcagcatgatttacaatcctttgagtatgtacccagtaatgggatggctgggtcaaatggtatttctagttcaagatccctgaggaatcgccacactgacttccacaatggttgaactagtttacagtcccactaacagtgtgaaagtgttcctatttctccacatcctctccagcacctgttgtttcctgactttttaatgatcgccattctaactggtgtgagatagtatctcattgtggttttgacttgcatttctctgatgcccagtgatgatgagcattttttcatgtatcttttgtctgcataaatgtcttcttttgagaagtgtctgttcatatccttcacccactttttgatggggttgtttgttttttcttgtaaatttgtttgagttcattgtagattctggatattagccctttgtcagatgagtagattgcaaaagttttctcccattctgtaggttgcctgttcactctgatggtagttttttttgctgtgcagaagctcttgagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttgatccatcttgaattgatttttgtataaggtgtaaggaagggatccagtttcagctttctacatatggctagccagttttcccagcaccatttattaaatagggaatccttttcccatttcttgtttttgtcaggtttgtcaaagatcagatagttgtagatatgtggcattatttctgagggctctgttctgttcctttggtttatatctctgttttggtaccagtaccatgctgttttggttactgtagccttgtagtctagtttgaagtcaggtagcgtgatgcctccagcttttttcttttggcttaggattgacttggcagtgtgggctcttttttgggtccatatgaattttaaagtagttttttccaattctgtgaagaaagtcattggtagcttgatggggatggcattgaatctgtaaattaccttgggcggtatggccattttcgtgatattgattcttcctacccatgagcatggaatgttcttccatttgtttgtatcctcttttatttcattgagcagtgctttgtagttctccttgaagaggtccttcacatcccttgtaagttggattcctaggtattttattctctttgaagcaattgtgaatgggagttcactcatgatttggctctctacttgtctgttattggtgtataagaatgcttgtgatttttgcacattgatgttgtatcctgaggctttgctgaagttgcctatcagcttaaggagattttgggctgagatgatggggttttctagatatacaatcatgtcatctgcaaacagggacaatttgacttcctcttttcctaattgaataccttttatttccttctcctgcctggttgccctggccagaacttccaaccctatgttgaataggagtggtgagagagggcatccctgtcttgtgcccgttttcaaagggaatgcttccagtttttgcccattcagtatgatattggttgtgggtttgtcatagatagctcttattattttgagatacatcccatcaatacctaatttattgagagtttttagcatgaagcgttgttgaattttgtcaaaggccttttctgcatctattgacataatcatgtggtttttgtcgctggttctgtttatatgctggattatgtttattgatttgtgtatgttcccattcatgttgtcgtacgtgtcaggattttattcctttttaaggtcgaataatgtctcattgtatgtatataacacttttgtattcatttattcatcagcggacattggggttatttctgcctagtgactattatggttaaagctgccataaacattgatgtagaaatgtacaaatttctgttcaatctcctgttttcaattcttttgggtttatacccagaagtggaattgctggatcatatggtaattctatgtttaattttcatgttaagaactgccatactgttttgtggaacattttaacattttatattcccaacaacgcataagtgtgccaatttctccatattcttactgtttattattttatgttttttataactatcctaatgagtatcaagtggtatctcattgtggttttgatttgcatttccctacttattactaatattgagtatattttcatgtgtttattggctatttgtatgtcttctttggaaaaaagtgtctattaaagttatttgcccatttaaaaaataaggtctttgtttcatgtttttgagttatagaagttctttatacattctggatactacttccttatcagatatataattttaatatattttctcatgagttgccttttcactttgttgacagtgttctttgatgccaaaaagttattaatattaattatgatgaatccaattcatcttttttccttattgcttctgctttcagtgtcatagccaagaaatcattggcagacccaatgtcatgaaatttcccctttgctttcgtctaagaattgtaagttttagcttttacatctagatctttgatccattttgagttagttttggtatatggtataaagtaagggttcaatatcattctttggcatgtggatattcaacttttccaacattctttaaaaaaaaaaaaaggtcctttcctcattaaatggtcttggcacttttgttgaaaatcatttgcccatatatgcaagggttcatttttaggatctctgttctatcccattggtctatgtgtctgtctttgtaccagtaacacacttttgattactgtaactttgtagtaagttttgaaatcagaaagtgggagatctccaactttgttctttttcaatgttgttttgactatttgcagttttttgagattccatgtgaattttataatggcttcttctgcttctgcaaaaagcattgggattttgatagggattgaattgattctgtagatcacttgagcagtactggcaccttaacaacattaaggctcccagtccataaacatgggatgttcttccatttggttatcttctttaatttctttcaacaacattttgtagtatttcagtctttcgctttcttggtaagctcattcttaagtctttctttttttgatgttattgtaaatgaaattatcttattaattttattttcatgttgttcattcttagtgtatagaaacatacctagtttttctatgctgactttgtatcttgatactgtgctgaattgtttattagttgtaacaggttttttttttttttagaatctttatagttttctctatatgatatcatgttgtctgagaacacatagttttgcttcttccctttcaatttagatgccttttatttttttctcttgcctattgctctagccataatatccaatattatgtagaatacaagtggcaaagggtggcaaccttttcttgtttctgattttagaggaaaagttttccgtctttcactgttgagtatgacattaggtataggtttttctcatatactcttgattatgttgaagtagttttcatctattcctattttcttgagtggatttataatgaaagagattgaattttgtcaaatatttgttctacatcaactgagataatcatgtgtttcttttttttcccctttgttctattgatataatgtgttacattgattaaattttcatatattgacccatcctggtattccagggatatatcccgcttggtcatgttgcagaatcattttgatgtgcttttgaattcagtttgctagtattttgttgaagatttttgcatcaatattcatgagagctattgattttaacttttttcttgtggtttctttggtaagttgtatgtttctagtaatttgctcatttcatctagtgagatggatttttggccaataaatttggaaagaaaagatctcaaggatagctgctgagagttattgtcttattatttatactccttatatatctatgtttaattaaatattgtcccatatttttatatcattttggtaaacagtacatcttgcttttactaaacaaattttaggatatccagggctcaccaaaaggtgaactaattgagaagaagtccaggactataaatccctaaggcagtcctaaattcttcagtggatttgtgccatttcttaagaaagcttgacaagtcattaattggattatagaaatcttacctggaccatggttgaaggccataagacccatcagattggtcatcatactcacataccttataagatataatgaagagatgttgtccaggggaaaagatatgttcaagaaagaacggtagagaaaagggaagaaggtctgttgaaggtgtaggaagaagaggaggagcaggacaaaagagagaaggaagtcagggttccgaaggccacgagggaagacaaccacagtggggtcatgagatagagaagagaaatgaagcttggatttcagatccaccaagtttttattagttcttttgaaggtatccttaagggaagccatttacaaaatcttctgtcctttagagttgtctttataccaaacaaacaaacaagctaactcttggtatttagagtatttgagtcctttgattttaaggtaccaggcaaaagattatctaattctgttttttgttttttttgtttgtttgtttttgttttttagatatgcccaggctggagtgcagtgaaacaatcctggctcactgcgcactctgcctcccgcctcccgggttcaagcaattctcgtgcctcagcctctcgagtaggtgggactacaggcatgcaccaccaagcctggataatttttttatttttagtagagatggggtttcaccatgttggccaggctggtcttgaactcctggcctcaagttatccacccacctaggcctcccaaagtgttgggattacaggtgtaaagcaccacacctggtggattatcttattcttatcccaaatttcccagactgtcatgtgaagagaaatgtagtaaaattcagtgtgtgacatagcccagagaagtactagcacactgacttaaatacagtattttttacctcctctcatgtaattaaccttcccaatgggagtattttgtttggttgaacaaatatagtttggtcaaggaaattatagtcataagcaatataaatttatcaatagttggtttttgaatccactctacgttccaaaagaaaattacacagaacaaaaaagtattcctagatgtttttctataatgccacatagtccatgtcaccagacctgatggtgaggaaatagacaacatagacttacctgtaagttgccatgtgtgtatctgatctgacacacgtttatacacaaaaactttggagtcatttggaaattttgcaactccaatatgatattattctctttagtaattctgtcaatcagttgggatctgcaagatgattgtgataaaagttaattgttagtcatagcatatttttttaactgatgtaatgattattattgtcctaaattgacaggtgaagtatgctgtccagatgaacagcacaatcgggtttctgttggcattggtgattcctgctgtggcagaatgccgtactccacctcaggaaaccagatttgctgtgctgggaggcttcatgatggccatggccagaagtgctgtggcagacagattgtgagcaacgatttagagtgttgtggtggagaagaaggagtggtgtacaatcgccttccaggtaaggggcccaggtctacctttcagtagatggaggatctgagaagcagagagagtgagaaatttgccctagaaataaaacaaataagtaattaaagctcacattggttatatctaatgcaataattaggaacatattgtttaacacataacaatgtaatctcccaatttttacatgtatctcatgtatttcataaaaacgcatcaattttttttcctcttgaaaaggtcatgtcctccaaaaaaaattccacacatgaatgcattggttatgaatgaaaagaatatttcctagcaaatagtatacaaaattattataatgatattttgttataattcttttactcccttattctactgtattaagctaacactaatataaataacaataagtatcattgaatgaatactaacagacactgtgccaatattttatatattattacctcaaataatcttcacaataatcttacatgataggtactatcaattatctgcattttaaaaatgaagaaactgaagttcagacattagatattagacattatcttgctaaataccacacagtcagatccagattttgggaagcctgacatttatgttattggaggtggggcttttaaagacaagaaaattaaaatatgaagttaatgttcacagtatcttcaccaggcatagattccatctcaagaagccactttctttgctcctccctaagaagcaactcctcatctgttagttttatgattgcagcaattcagttacctcttcaggcttcacttctcattccagttctcttgctatttccactgcatctgcagttatttttcccattttgagtctaaaaccccttagtcatccatgagggttggaatcaacttcctctaaactcctgttaatgttgatattttgacttcttcccatgaatcatgaatattcttaattgcatctagaatggtgaatcctttccaggttttcaatttactttgtccagatccatcagaggaattactatctatggcagctatagccttacaaaatgtatttttaaataataaaactggaaagtcaaaatgactacttgacctatgctgtgttaataggcatgtaaacattaattttcttgtctatttccatcagagctcttgagtgaccagatgaattgtcagtgagtattaatattttaaaagaaatatcttttttctgagcagtaggtctcaataatgagcttaaaatacatagtaaaccatattgtaaacagatatgtaatcatacagcctttttgttccatttacaagcacaagcagaatagatttagcataattattaagggccctagagtttttgcagtggtcaatgagcatgggcttccacttaaagtcaccagctgctttagccccccagcaggagagtcaacctgtcctttgaaactttgaaaccaggcgttgactttttccctctacctatgaaagctctagttggcatcttcttccagtacaaggctatttcatctacaatgaagatctgttgtttagtgtagccaccttcatcagtgatcttacctaggtgttctgggtaacttgaggcagcagtttctacatcagcacttgctgcttcaccttgcacttttatgttatgaagatggctttttttcttaaacctcatgaaccaacttctgttagctttcatctattcttctgcagcttcctcatctctctcagccttcatagaattaaagagagtaagagccttgcctggactaggctttggcctaagggactattgtgactgatttgatcttctatccagaccactcaaagtgtcttcatatcagcaataaggctgtttcacttattcataagtgaatgataagtgaaatagaaatcttacctggaccacggttgaaggccataagacccacaagatttgtcatcattctcacataccttataagatataataaagagatactgtccaggggaaaagatatgttcaagaaggaatggtacagaaaagagaagaaggtctgttgaaggtgtgggaggaagaggagcattttgattttcttcaagaactgttcctttgcatgcataactgggctaactgttgggcatgagaggtctagtttttggcctgtcttggctttccacatgccttcctcaataagcttaatcattcctagcttttgatttaaagtgagagacatgagactcttcctttcacttgaacacttagaggctattgtaaggtaattaattggcctaattttaatattgctgtgcctcagagaataggaaggcctgaggagagggagaaagataaaggaacggctggtctgtgaaacagtcagaacacacaggacgctcatcaactaagctttccgtcttatatgggcaaggttcatgacacgctaaaacaattaccatagtaacatcaaaggtcattgaccacaaatataaatataaaatataaaaattaaaaatataaaaatataacaaatataataataatgaaaaagtttaaaatattgtgagaatcatcaaaatgtgacagagacacgaagcgaacacgtgctattggaaaattggcaccaatagacttcttgatgcagggtggccacaaaacttcaatttgtaaaaaaatgcagtctctgcaaagtgcagtaaatcaaagcacaataacgtgaagtaagcctgtgatactaaactactatatgcctttttaactcttattctctcctatgtgtacagcagagcttttcagatgttacatggcatgatttgcaacagatcgaatgcagactcagaaagaaaattaaattgacttctcttaactaaacatttaaaaagcttgcaaaaatataacacaatgtcattcttctattttttatttgaaaaacatttattttcataaatatgttagaatgttatagatttattattttatgtctaaatgcattaataaatatttcaaaaatttctgccgtaagttttaacacagtacatatcaacaggtaaaacccatataaacaaaaggtatttggggtcctcaataattcgtaagcgtataaaaggatcctgagaccataatttgagaaccactgcttaaagtcatagtaacgtctactagaaaattatggcaactaattagttatcctgtactatgactaaccagttgaatacctcctcctcctttagatgaagtagctaataacaggtctattaaagatagaaccaaggtggcagggagggtgcaaaagtgttacctcctgtgtactctaatacatcagagtttaaaaatgacagcaaaatatttgattttagtgtgtttgttcatctgtagctttttaaaagaattagtcaactgctatactccgtcctttgttaaatatgtattatgtagtaaccatattcaagacatcattcttggtgctttgcaagtgtaaaaatggccaagattccgtttttatcctcaagaacttacaacctaatcaaggagaaaagtgcctacaaggttatacacagaccataagagagggatgaatgcatgcatattcttaagacggagagatcactccagtcaaggtaatgaagggggttgttccattggattggaatctcaaacagtgagtatgattttggcaggtgtggcttgagctaaactgtgaaattagcaatctgcaaaacacaaataatagcgtgtgctttggtttacaggaggtatacactctgtgtaaggaagaaaggagataaatctgagtaggcaaaaggatttgaacattatttagcactcagggaagagtcaatatgatgataagaactgtagtttaagattaaatttaggtgtcagaacaaatacaatagagaaggaaagagaagtcagaacacccctggcatgaagtaaaatacatctgttctaagaagtggaatggaggttaccgtccactaggacaatggttcttaacttgttttccttttgaatcttttggaagttacaaaccctcactctgaataatagtgcatggaatatacacaaaaatttgcctgtaattttatccacccttgaactccatccatgaactcaaatttcagaatcacttctttatttactccaagatgatgtcgcatgccagtcaaacatttcttacacaaatggtgacagccctcaactcttgcgaatcaagataagctctagagtttctcatggcattctacagctctgccaactctgataatcatagtggacttaaggaataatagttttacaaaggaaaaaatatatctttttattctcttgactttctttctgcaggttgcactgaaaatagacagattccacatgtatttttcctctctctgctgccgttcactcctgtagcccctaatgactgtgaccttaatgaccttccagaatatccatatggccctttttctcctcaacctagcaacaaacagcatacctgctacataagtgtttggatctcataatatcgttcctaagcctggcctctctcgctgcctggcattgtgtgcctgccacgagaccgggctggctcgtaaaacatctctttatgtactttattacttaaactcttttatttgcctgcaggagccctttaacaaaatcacattgaattgactttctcacaccaaatcaaatctccctggtcccagttcagttgtctttgtcaatatgtattttataaatggagtgaattaacagatgctgttggaacagaagtgctggggtggcgtttatgtttttagtgctctctctgggcagatgcgttgtgtagaagtgttatacaggtatctcgggatgaaagtcatgcgtgtcatttcagtggatatgtattcttagccattttctttgaatagattttaaacctatttattactcatttttttcttagtgtttgcttatatagctttatcatttatgccattaatcttggattggacttgattatatcccttagtatgaaaaggtgaaaaattaaaacctccgtttcattcaaagaggacagatttttctattagccatgggaaactgatcatgagatgactttggaatatattgacttatttatattataaactttgtccatgcggcctttgatgtgaaactctgagttgaaattgtttcagaatacaagactgagttttcatgtcctggactctgacttcagtagaacaaatgactatcgctgtttgtttcataagatgggaatttgggaattttgcagagggaagtataattacagaagtccatggtgtaagggtggcattgaaaaaacatttccctggaagatttccataaaacagaatgattttttttttgaaaagtgtaatatatcagtgctataaaatgtatcacaatgatttggggagcatttttactctaccctctgttttgtggtggtagtcacagagccatctactggtgaagacaagtgtgaatttcttttctttcatgctctgccacaaatgttatacatttgtcctaaggatgactaatcacaaaccttttttttcttctaggcctaaaatatcccttggcttaaaatttggtccccatgaacaatctcagagtttcacaatgatttgtcatattccagactggattttactactatactatttttatctcaaaggcatgatacataattcttggtcttctttaaaaaaaagtggaatcccagttttgcagtcttaactatttagaaattcatccaacagatatgcttataaatgcttttctttttagacatagatatgaaataagcattggtaacatatttgaagtattaataatattgtgagtaaaaattttttcctccactattttctcagttgtgtccaatcaatggaaaccattggatatatatacagtttagaaagacaatatatgctttttcatctgaaaaataaacacctactagtttaatgtgtactgtaccactttactaacatctgcattttgttcaaagacacactccaccttttgtacaaatttaatgaagaggctctggaagaatggaccaatccatcaataatgcatgacctattttgtttttctttgggcatatttaaaatcgtgcattccgtgtgtcaaagttcaaaagtcaagtgctacatgtgataaattaggtaggggtcgaaagttattgcaatgcagtttcggaagattgtctgtctctgaatttgcagctcattcatgctgaagtgatgcactatgggaattactaccaaactctgctccgcaacatctgctctccctaagtgagttagtgcacgtcagacatctttatgtcagaatattgcagtgatggatgcagtcttcagaaaatgctgcataaaaatctggtgtgccgttctggccattaagtgaaattactatttaaattaatggcactgtcacagtttatctgtgcaaagaatgaacgctgattagggtattaagtaattagcaatttatcacactggaacaaggttgataataattaaagaagtaatggtttaccaaagaatctaaaaagggagtcacttcttgttatgtgagtgaaatcttggctgaaaatttcaattcagtaatacaaagatgaagctctttgtgaaagaaggcatcttttttttctagtttaaaaacagttcattatcaaaattttagttgacctgtcagaagtccctcagagtgatcagatgactgattaggagtttcaaattaggtcaatgtctgcatttttattttatacttaaagcatagtgaaaccatgaagtaatttgggaatgagagggggagaatatattccgctccctaaagggccagttttcaaattttgattgctctttaaaagagaaacatgaattgtcttcagaaaactgccagagaaaaaattaacagtaaaaaaatccatggttgtatttaaatgtctaatcagaaggggcagaaaaatgcccgaacaatataaaacttgaagctacggatttttctttttagtttatgtgtgtgtgtacactcatgtatgtatatatttatatgtatttgtgtgtgtatatatacacatacatatgcatacatacatagctacacacacataaatatgtgtatttgggtatgtacttatacatacacacatatatacccaccataatccagactcagactaaaatgagccctgctctttgtattaatttgagataacttttcctagaaatgttaaaaccactaaaattataaatatagcagttaatttgtaaaccaattacttcgaagagttatcacattagataaacatggtatgccaaagctctgttagaatcagtgtatatcattaatcataaataagagtttttaatattagagacttttgtaagtaaaaagatgaatgagagggttctttggagtcatgtgtggataaacatctttcttaaggcatgtgccaaaccaatgtctactttcaatgattttttttaaaagcacttttgatcttttatttgagtgtctttaataatgtagatgtttacacaggaccagattaaacaattcaggaccccagggcactttgaatttgaggttctttatgttatcagtcggaactaataataaacaaacaaaattccaattaaaataaatcattcatcacattgtgctgctatataactggatataaattctaatataaaaacactgtgacatgcagtatagccaccttgatttctagcttgatctgtctctagagtagtgttaatttattcctgctttaatgttaaaatttctgccatttctctttgatggcaatatctaaatgatgcaaatgcaggtaattaaactaaatttggtgggagaaaatgtctatttggtatctcaggtacgtgtgtctttcgtttagatgtggggatcagtgatcctctctacaaggtctttctgcggctgcccccagcctgtcacctgtgtctgtgatgggtctagaacagagtgaggctcaaaaaatagtggctgattagtgcacctgatcagtgaacatgctcagctgattatgaataaataccaaatccatctcatgcagaaaacatggttaccattgcagctaaattcacaagaaacaaatatttgtaccctaaataaagctaagccaaaacttgcactgcttctcccgcagggcttccagttctaggatggtgctacctttccactctgcctgggcttttatcccagagtacttgggtgaccttttctcccttatgaatttctagagctttctcagagtccctatagtttaactaaccttcttctgcaacaagatgttatcatcacaaaatgcgcaggcagttttcatgacagaaatcctatctctttttatggagcatgagagaagtttggcccagctgaatgattttcgaacatttcctcttgtgtgttcttttcctaattagtgtctagtgctcttggtaagaaggaccctcactgcacatttaaatcaccttggtagggaaatgctaccttaggtattgcaccatttcagcaactgcctgagcctgacatttttataccaaactttatagcagcctcagttttcttccctttttctatttcatattcatatataacattttattgttgcaggtatgttctgttgtgggcaggattatgtgaatatgtcagataccatatgctgctcagcttccagtggagagtctaaagcacatattaaaaagaatgacccggtgccagtaaaatgctgtgagactgaacttattccaaagagccagaaatgctgtaatggagttggatataatcctttgaaatatgtttgctctgacaagatttcaactggaatgatgatgaaggtaattgatagaaaagctctcggaggcgctgatttgacaatggaaagagaaatacattgttcataactatttttctaaaataggaatataaaaactcctgtgtgcattattcattttcacattacatccatattaataccgaatgagttcgctatgattgatgttattgcaatgaattctaaaggaattaataatgattagctgttctcagggaagctttacccagcacttcagattagtgcaggactgaaagtctgtgtgccactgaaagagccagcacaggtcgtctggggcctctgcatggtgccatttcatgcctgggagcactgtggatggaggcaggaggaaattcccgcttcttctccctagcccgccagccatcatccaccactttcctttgatagagaccttagatccagcaaattcgcttagttgcatttatatcatattcccttggacaatgcaagatgagcaaatgcctgtgtcaaaagtgaatgaataggcttctgggtgtaatcgcttatgtttttgtatggtgatggtttgtacacagccatgtcatgtatgtgggtattaaacttgacccaggataccagaagcctatcaatttaaggaaaggaccatggacactttaaaaataaacatgctaccgtgttctgtagtaatttgtcattataagaccactaaaaatgggtgtcttggtcacagacaatggaaggacgcttgttcaatgaggcaactacacagtccttgtgtagaccacatacactttgtacactttgggatgtaaaataactcatgagattgttagaagccctgcaagcactttgtatcaatgaatgattaagataacacataaggttggttaaattattctaatgaggacaatatttctccatgctgaatcaagtagtgtgtatacataataatgttcagtctgtaggtttcattttgttttctgaagacctaccacctggagacatttatatcctgttccagtctggaatggatcaccatgggatttttacatagctggcccattcggtcttccctaagctatcaattcaggaattccttttacctctttcctgtgttgattcccctgtttttttgttttgttttgttttgttttgttttgttttggattccaagtttcattccatttggagaattatcttcttgtatatagatgtatggagggtaaattttttaaaagcttaatgtataaaaatactattattttaccctccaacaggattgatagtttggtctgatatacaattccaggttaaaaattatgtctactcagaattttgaggcatttctgcatgttttaagcttccattaatattttgattcctatctctctgttggtaaccatgtttcttttcctatgaaagctcttgaagatgttctctttatcctgctcctctaaaatttcatgacaatgaacctctatgtggaagttaggatggtttctttttgcattttgttttccatttttgtgatgagagcatttaggatctactctcttagcaattttttttttacattacaattcattatgagttaggcagttgtcttccaagtaacatctctagaaccgaagccccttacatcttgtgatgcttcatgcagcccttggatcataatggaaaaggcgcaagaggggacaattgcacacagacagttcctacctggatatagagtacatcctttctatgcactagtcacacagacatatctagtcaggtggcttctcctactgcagccaggtttcaacatcccatgttcccagagagaaaagggaaacatggacatcactgagcacattgcattgtctctgccacattcatctactttccagcttccaaaaaggtatgcactgtcttgtgtgtattatttttctccattttttcttagactttcaacacgtaaaccagtattttactgtcatttagttgggcttttagaggatagatagatagatatagatagatagatacacacacatacacacacacacatatatatatagtgggattctatttatgtagtgtcatcttggctcactgcaacctctacctgctaggttcaagcgattctcctccctcaacctgccaagtagctgggattacaggtgtgcgccaccaagcccagctaatttttgtttttttagtagtgacagggtttcgccatgttgatcggtctggtctcgaaatcctgacctcaagtgatccacccacctccgcctcccaaagtgttgggattatagacatgagccactgcgcccagacccactatatatttttgaatgtactattttgatcaacttggtaagaataattcaacttattttatgtaagagagaggctgaatggagatcaattttaatagcaaaaagtattctaaatacattatgctacttatgtaaaggaaaggcaaagtagatctccacattataaaactattaccttacttatagctcttgtagtgtgggatgattaagtatttaatttccttggattaaaacaaagtggtacttatcaaaaaccataaaaaatctggagatgtgtcagagaaaatgtttataagcgtaaataattataattacaatgacagttcatgaaacatttatatttttaaaaacttggatcagtaatacttctaatgggaccaacttccccaacaacacaggaagtgtaaattctcaaatatcacattctttattttctctaaaattccataggaaagtatcaaatagcaaaaataaaatatttgtagtgtgtatactaagtttaaagacttatcagttttgagtcacacaacaaaccttggtggtaaattatatgatttgagtcacacaacaaaccttggtagtaaattttgtctccatgttccccactgaagaagctgaggttttgaaaacataagtgacttgctcaaggttacagagctgggaagctgcaaaactgaaattttaatcccaatttgtgacatttcaaagtcattgttcttcctagtatacaaactgccttcatttctttttataaattttgaaatattcattcatcaagtaagtggaggaaaaatttcatttgaaagtcacaaaagcctaccctatgtatgtctaaatgaaatttttaaatacccctctctctctcacccctgccacttgactcaggaaaccaaagagtgcaggatcctctgcccagcatctatggaagccacagaacattgtggcaggtgtgacttcaactttaccagccacatttgcactgtgataagagggtctcacaattccacagggaaggcatcaattgaagaaatgtgttcatctgccgaagaaaccattcatacagggagtgtaaacacgtactcttacacaggtaacagaaagcaagctgtctgcccatggcttaatggggttagtgagaagctgctgaaaatgcagatttatttcactctgacatcaactctccttaaactgatatcagtacattccatcatactttgaggccagctagttacaaggtaattaaaggcataatctggatgtattcaaagtcagtactttaaaatgtgttaaagtctatttaaacaaggttgtattccatattaaggtaaatctgtggagatatctgtgacctttactgctatatccagttaatttacaataaatccaatttcctttttcaaaagctgcaatgcagcttccactgaatgcattgaatgaatactgctatactcttaagcagaaagaaggatgaacctgtctgattaataataaaacctaacagtgctactctgaggatgaggtaaacccaagcatgacatttctccaagatggctggtcatctccaaaagaataacctttgcagttattgtaaatattaatttctatgtaccatcttggccctgctgaattagtccaaaatggttatgcttagttttggctgagctgtgtgagaaacactgttaagtttagaattatctctaaaacagttctgccatcaattaaatttgtgttattcatccatttacttaagtccctacaaaatgtgttcttgttttttgaaaaatcaagtttgtgtgtgtgtgtgtgtgtgtgtgtgtgtgtgtgtgtatcatctatcatcttgattcaatagaatccatttaagtgacataatttgagcaagctaaggttaataaacaagcaaaacattgctccattccatcatgaatcatcagtctgctttactcaaccaaggggcaataatggctaacctcaagagtgcagaaagtaaggcaggctactaagataagaggaggaagattaggaagggaagaaaggaacagagataaggttgattgaacattatttagtctcaatgttatactaggtactttaatttttttattatactttaagttctagggtacatgtgcacaacgtgcaggtttgttacatgtatacatgtgccatgttggtgtgctgcacccattaacttgtcatttacattaggtatatctctacactaggtactttaaaaccttatctcagttaccaacaaagcaatcatataaatatggtcatttaacagatgaggaaactgagggtcagatctgtaaaagttactcgccatgagaaagaaacatattcaaataatgccatcatcaaaagggacagactttgaagactccacgtggtgcaggagctcctttcagagtgctccaaatgcacttcaagctgttattccacctgaaatgtcctcctttatcatcctactcaaggcctaggtcaagattcttttcctcaatgcagtccctgtgctgctatggcacattgttcacaaagctcactagctctctcatgtgtcatatggatttggacacttgttccagctcttctattagattgaaacatccttatgaatagggcatttttgtttacctttgcctcgttatttggatttagaacactatacaaacaaaaaatatttcttggaatgaatttaattaggaaaggcctcagatagaggacaatttgtccaaccttctattgtgttcccagtcccagttatagatttaagtcatggactttcatttttaaattattgagtttccatctaagagagttctctacttttatctgccccttgtaatcaagatcaagattttgaagggcttttaataaatacttgtaatagccctctccagaagtgaatagatgtttccacctactgatataatgttatgagggcttttaaaatccatatttcagattgctttgcctgcagaaaatactacaaattgaatatgaaaaataacaaactgttctttttcatgaaagatgttcagcacacaagtggtgctatgataattccattgagaacaatttagattaagtcagactcttttagaaacttacacttgaaagctgacaataccagtgctgacaaaaatttattcatttatgcaatcatttatttatcaaaaattatttattaaatacctactaataactagtcactacattaggactagcagctatgatgacaaacaataatttttcattgagatttcaaccctatatgaagaaagaaggaagcagcaaatgagatttgaaatggtaatgtgggcttgaggatacagaataacagtcattaccaataagtagtttaatttgctgtagcagaaatgtaaaacatattgaccatctgagggtaggtagatggtctaggcaactgaatcgcacaaggtcattcaggtatccagaatccagaatggcaaccgaaggtatgcaattttctctttataaaatgatgtggaagttgtcagtgtctttctatactccttcaagtattgagatctgagtcatgtgaccactagaagctacaaagaaaactggcaaatgtggttttctaagcaggaggcctctgaccaggatggaagggagaactggggactcatggttgccatcacaggcaacaagtggcagatacccccgagcagaaaaaaatggaaaaggaagataatgctttacatttgtagagcaatctgcattttatgaagttctgccccataatttattgcattgtattttcatattagttctatacagtgggcagggaagggtttattgtaaggagatgtatataaggagaatgtctctccattaatctaagcatagagactgagaattaactccacgtccaatggagatgagcaggtggccaggcagccaaggaggaaggcctccttttctgatgctcaatctgagaaagagtcatccagaagctaacacacaaaaatacatacatacttacttaaaattcatcaaattagagacatggaaaataaatttaaataattaaactttcaagtaagtttttcaggggaaatgtgtagcattggtatttccgaagttattaaagcctaaatggaactaagactttggggacacaactgaatcacatgagtgttcatctaatacaatttttgccagtttggaaagctcagcaggcttggttttattgttttaataaagttggttggtttgtattttggttttcagttctggcttttgtggaagagggaaggaactagatagcagagtatgctttcatttttattcactaacatggtaccatgataaactaagtttcaaatcctgtatattgtaacaacattataatccatatgatttaaaattttttaagtaatattaacaaagtaacagaaagcaataatttataagttctatgatactaaaactataaaagaatgttgccaaacctgtctcatgtaggaatcaaaactacatgaatttgtgaagcactaaatcttattatacatgattccagtgcttttatttttcatttatttaatatatccctctttctctgctcagaaacagggaattctattctgtgcaattccgtatccctgcatctaataaatactttaaatgttacttatatttagaaaataaagatattagagttttatttatatacaaagcgtttagagcattaaacatttatttttaaatgtctaaagtttttgatattcacttttaatatgatggttaaaaaatgaaaataagagaaacttccctgtctattttttctctttccagatgtgaacctcaagccctacatgacatatgagtacaggatttctgcctggaacagctatgggcgaggactcagcaaagctgtgagagccagaacaaaagaagatgtgcctcaaggagtgagtccccctacgtggaccaaaatagacaatcttgaagatacaattgtcttaaactggagaaaacctatacaatcaaatggtattgagatacctttaaaatacaaataacaaaatcccataaattcataagaaaattgaaatgagtacaatctacatttaattgccctatgcatctaaccactagaaaagtatgttccgataaagggaactgtaattatgtgacaactaatcactcactttgtggtgtagtcctcgtagatttttagcctaaataagtaaaaaaatagaaatgaaagttccttgaatcccagaatatatctgagctgctttcaaaacaagcaaggcatattcagagaaggggaaagagttttaatattgaaagtaaatttgtttcatagtgaaaggaaataaacataaatgactcttatcatttatgtcaagaatccatctcctccataatagtataattaggaactgcttgagacagcaatataataggaaattaaaattaaataaagctatagtattgcatttcttccgaacactaagatttgtaagttgtttgcaaatagttaaaatgatatcacattcaaatgcagtcatttttctgcttcttttaggtcctattatttactacatccttcttcgaaatggaattgaacgttttcggggaacatcactgagcttctctgataaagagggaattcaaccatttcaggaatattcatatcagctgaaagcttgcacggttgctggctgtgccaccagtagcaaggtaagaggagtttgcctaaactctgggaaaaggggttcagtgtgaagattatctgaacatccaggttgtgactgcttttttcattgaagaaaacaatgtccctcctcaaagtggtgttaagtagcgtgttcatgtgtcacgttaactgagtgctaatacctatggctggaaggagagatcatttcaagggagatttatccaaatatcaatcttgtgttaatgaaaaacaagtgaaatcttgaagcagtaccatcttttcttccacattctttcctcaccaaccaattttaggtaatctataaatctataaaaatgtccaaatcattattcagttaaagaaagtttctatttaaatatgatatgaacaaaaattgtctgattttaaaaaatgaagagaagggcaaaaaagcctggcacggaaaacaaaattgttccaagccttctgctatagccttgtcaagaaataatgaagacctgaatttaggcagcagaggtcagaaccgagaatacagaatgatacaacagacatgggggataaaatctacaaaacttggtactcaattatatttacagaaataaaaggaaagagtcacggatattgtcaaatatctgcttgagtaatttgtggatcatggtgctattctgcaagcaaatttttaaaaaagagaaaaatgttgaaggtaaaagaataggattctgttttgttaagttttgtaaaaaatatatttaaagagaaggatcagatagcagggtggcggaagcagatagtacttggcactttatgtgaaaatatctggtcagaaaccagattgagaggtgactgaagtttctagaaagatctgtatgggaagttgaagtaatgagtataaatatggacatggaaggagaatagagagaaacaaatatggaatattgtggatgatgagcactggggaatgctaccaaatgaaaaagaaagaaaagcccacaaagaagactggaaataaacaatcaaacaatgtgggagtaaaataaagaaagggacatttcatagaagccagccttgacagaggaagcccaggaggaaacaaacttacacagagtagctctgattcttttcatatgcttaaaactttagaagagcaacatctttgcacactgtgcaagagccatccaaatgaaacattcagccacactgctcagccacagtgcaagaatgcaacattttgttcaacagacttctggaaacctttctgagtgagccaccatttagatagatagatggcagctgattggcccagtcaaaagttattagtcctagaacaattccatgctttttgcataggcacacttcatgcctgctacatgcaaagcaattgtttacaaagtgaaaaaagttaattctatgaaagaagccaatttttgtccaaaactatgttttgacaatattgactaagtaattgatttatttttttcttctgacttgtttctttctttagaaagttggtgcagacactataaagtcatcctaggtatcatgggaagagtaccgaaatgtctgcccatttattctgttcaaagcatattgtatgcaagcaagttcagatgtggcttttgctccatatttactggtgcttaaaatgtatgaaatcaggctgttaaaatgcaaagacactgatgggccatatggaagagagttatcaagagttctctagtaagacagtctgccagccagattttacttgtttaaacactgagggctgcactctgccgtcaaaattgttgttgaacctgttgtgataaatggtagtgtgagacttatgtaatatattcaaggtcagatttcattgtttaaataggttgggagggaaaaaaatgaaaaaaaagggaaatgcttctccaagcccctgctaatgatatgccaggccagacaacattttaaaacaaaagtgacattctcattgatcaggatagctagtgcactattacaataaattgctgcttaattcctacgtcttcaggtagttgcagctactacccaaggagttccggagagcatcctgccaccaagcatcacagccctaagtgcagtggctctgcatctgagctggagtgtccctgagaaatcaaacggcgtcattaaagagtaccagatcaggcaggttgggaaaggtctcatccacactgacaccactgacaggagacagcatacggtcacaggtgagaaaacaaaaaaaaaggaaatcctactggaggagtctgtcattgtggttaggggggcaaagcatcccaggggtgtgtgtttgatatatgaggtcacttcgaaaggacgtgttctcttgacatatggtcaggtcccacttatccatgctaatagaagagcccacactggcagcaatacgccacaacagcagataacttcagaaataatttatatttggccttgatatgcattatgtgaagggtttttgcatcagtattaactttttttttcaaacaaacagtaagatgcattttcattccccaaggatatactcatagttaatgggactaagatagccaagaatatactggaaggcaggggaaaatcagccagaggttaacatttgtctatcaagtggataattaatacacaggactagttgacagtggagtcattgtgactgtttgttactattaggaatgttaattaatagcaattgtgtttttttaatttattataatgtttattatcattagccttaataatatactattagtacagtacaatgatatgttagataattgctagtagtgattatgataataattaacaggttttagcttaaatgccacttctgaagggaggagaagcattttctgacttacttgctcgaataggttctctaacacaccaccacatcactttgttttatttccatcatagacctctcactgcctgatattttagtgtttgttttttgtctttttatgtctctccacacttgaatgtaggctccaagagagcaggaaccttatctacttgttcagtgttgtacctctagcacttatagtcctgaacacattaataggagctaaataaacgtttggggaagaagggaacttaatatgtgccagacgctgtcctaagcactttgagtgcactatgcaatttgattctccatcaccaacctaagatgtacagtgaattactaccttcattttacagaaaagaatactttgagaagttaagtaatttagttcattattcgagtctactgaatcatcccaaacaaccctgttaagtttaaattctaagaccatgggcaagattgtataaactttcccttttttcccattgtcagccacctccttccaagacttcctgagtggatgacctccttccattggactgcactttttgcagggggtgttgatagcacagataatgaaactcacagaaaagtgcagaaaggccttggaaaaatgtgactgatttttcctaagaagggacacaggttacacttacacagggtggcaaaataaattcatcacttttcactcttaaatgccacaattccctaacacataagcaagcattcattgacaaaatctccagtatttttccaaaagggccgtaaacctgcagaaggtgcttaatacaactcttggcctggcacattgtattccttacctcaagatcctgggctaaatcaatgatgatagtgttgaggctgggtgcggtggctcatgcctgtaatctcagcactttgggacgccgaggcagccggatcacctgaggtcaggagttcgagaccagcctggccaacatggcaaaacctcgtctctactaaaaatacaaaaatcagttgggcatggtggtgtgcatctgtaatcccagctactctggaggctgaggtaggggaatcactccaacctgggcggcagaggttgcagtgagctgagattacaccagtgcactccagcctgggcaacagaacgagactctgtctcaaaaaaaaaaaaaagataatggggttgggagaagccctcatatttgaatgatcaaaattatttcttttatcttattttacttgaagtggaaatcatcacaagtgattgaaataatggtgttttacataataaaaccttacttctatgtggtgctttatcatttaaagaaacgtttgcattttgacttctctgactctcatcacatccttgtaagagatgtttttaataatcatatctgaaagatgaagaagaaagccaacctactcagcgtatccaaggcattcactgcctgtatctgaaaggaaatcagaatatcatttcgttctcccaaaaatgaattgccagcttgcagttttccagatagtacactaagtggtctaaaataagactgctgctcttaagatcctctcacgtacagggaagactgacaagaaaagaaataactgaaaacagagctctatacaggatgcagtggtgaaaaatcaaatgagtcacttggagtaagcaatgggatgttaattacagggttttgaaaagcaagtttaggcacattaagactgtaccagcaaaggtttcacaataattgtgatataaggctaaagaaatttcttcttgtagtatctatcaacttaaccagcatcagcttcgaattgttgctactttattggtttgcattttttagaaatcagcatttatacaccaacagaccaaattcaattgtaatgttcaaaccaacaggattgatagcctcattaattataaaataattgcaaagatttttctctaaataacttcaccctaccagttcttcctttcattgacatttttaatggctatttttatgtcagagtagatttcatacatgtatcttggtgccagaaatcctattattagcataaatattttaaggttttttaatataattttaatttttacttaacagtaaaaaatcataatctggtaaaagcctttaggagtcctttgaccaatctccctgttctacttttgatttgttttaatttctatggatattgttttaaatagatttagagagtatttcacttgcccaatacagccctaaagaggggtttctttgtagaataaagaaataagtcctcattcagcaaaaccttaccaagtacagagcctcctatatgtagttctttggggacaggaatggtgctaggcattagataatcggaaacttgagatctatataatgttactcatttgcccaggaaaattcagttccacggttagctgactgaccaaatgtagtactgaagtattttatggtgtgaatgactgttttattgagttcatggaatgaactaaaataatcaaatttattttctgttccatcttaaatgtttgatggaaatgctgcctgaaccccctaggataaatgttttgattttctcatcatttccaaaagcttggcattccctaagcaacacagcactaataaagctgtagcactagtcgtcctggagcctgaaaatctaggtccttaggaatgacaggagggaaagggagcaccttgcctcggccccattgtctccatgcttatttttaattacctcaaagctttagaaacatgatcccgtaaatgctttgtgggaatagtggcgaatgcactcatcatgtgaaatccataaattgcttataatcctctcaagatgttaaaaaaagcattaagtaattgaagacaggaagtcctcggttaattatttagaggtgttatcaatgctttaagtaaactgaagcgttttctgctatctcactgagctgaataccatggggacgaaggagtagcagccatcatcttctcatattcgctaatgcaaacagcgcatggcagcttgtcaataaaagaccttttcatatcatttattactaaacacatccaccatcctgtacagaacaatttggacatcagttatggcattgtttcactttgggctacctctacattatacgtaggcctcctaatgtgagtttaggaatagaagaaaggattaactaaataattaaggccactgagaaaaaaatgaattagtcatgtcctgtttagcataacgtataataagggcctatgtgtctcttactctggaaaactattttcaaaataattaattagaaattactcatcattgcatttcatttaaaaggaaaaactcaccagcattaaattagcaaggaaagaataatttactttcgtttctcatcttcctagaagttaatgaaaactttgtgtgctaaatagaacaaaccctaacaatgctggttgtagcagaaaatgtaatactaatgttatactgaaacagataccttacacttcaccttggaaaaagagaaaacatactttaaccaccaatacaacaaaatgtagaaattctttgtaagggattttatttttagataactctgctatgtgttcccatattatctttgctctcgtagtaattatcacattttattctaatagcctttcctcttgtctctgttccacacttagtaataggtaatgctttttaagtacagagacagtagcttcctgtttgccattgtgttcctggtacctatcacagtacttaatatattcaaaaaatgtttgtcgaatgaataaatactgaatagtaaactagtatttgactacattctgttttgaatggagataaaaatgccactgtcaaacgtatctaaatcgcagacagatctggcaacaaaattgtggggtccagtgcgaaatgaaaattcaggccccttgttcagaaatcattaaaatttcaagacaatggaagcagagcatagaagtaagctcatgtgcttccaagcatggtaccgtgtttgattgcacagtcgaagcccacaaagccaaccctgatctccagcagtctggaattagctgcagtatatttctttaattaaaacagatagcaagaaaactaggatggtgataatgtcctcaaaaagctttgggagtttcttctatggttgtttgcaatgctccaggctgcattccccccagttactatgtaattactgaccaccaagcactggggacctgtgaaaatagagataagaatttgttttcttttcattttttcaactctgagaacaactaaatttgtgcctgaccaaaaaagtaaaaaaaaaaaagaaaaaaaaaagtgtggcatcaaccacttttttgtgttttaaaacctgcctattgataaaatattaaggccaaagaactataattgatagctgcctagacaatgatattttttaaaattccccttaaatcccagatattccaatgtactttgccagatactagttctgttttgtcactccagttctggccacccccttccctctgcaatgtcctcattgtctcacgtttgagcaacatcagattttgctgccacctgacatcacattttgtttttagagaagaaaagtctgcctggaaatgcagagaagaatcctcagtctagcataacactgaacttgaaagaggaaaagtatttattaaaatatttattaaaatactgtcactaaaatcaaaatatatatatcacagatataattcatattatatttttgttgttatatttattccagatatacatcaacattaagactattatttagacaccaccaaagaaaaagggtctttccttggtggtgtctaaataatagtcttaatgctgatgtatatctaaagagagtctgccaaagaagtaacttgtttaggaaaggcgtcttgggatcaggaagatattggagagaggggcctaagctatggcccagaatttcaaatgaaatatagaattaataacgcaagttagcttatagcaagtagtcagaactaaaagtcatgaagtgatcttactggcatgtgcaatgcaagagtccctttgttttgatgttttgatgttcagttcatatgaggtagcaactgaattcataaagcatgaatacagaaaatggacagtacaaatgctgctcaatgggggggaggaaattggcttgggtaagtggaatgggcagctgttgagattgtgaagaatgataccatccagaaaagatggctttagcatgtgaactcccgaaataatccttaatcaaatcctgtaaaacaaattctaatttaaaggtaccttagatgtctgtaaagtaattccatgatgcctttgtataccagttttgaacatctggattttcacagattgtcagattgatctaagtagaatgctgatatggctctatccatcacagtcaagatcaccaggggatgctggaagttcctgggaatctcagtaggcagagatgctccgaaagggatcacttagtgagatcccaggcaagtgagggcaaaaggaagcaacatcattatagttgtctgggtatatactctggggctcgttgtcttgcgccaagaaagaattcaggacacagacacatgtgggtgtgttaaggagtggaaagtttaatagaagaaaggagagaggagagcagctccttgtgagagagagagagaaagacagagagagagagagagagagacagagagagagagagagagacagagagacagagagacatccgtaaagtggggaggcagcggaccaaagcagattttacaggcaggctggagaaggcagtgtctgatttatatagggctcacagattggttcgatcaagtatgacatttacatagtgggaggggaaggctggtcaccccaccctaatcttattatgcaaatgggccttccagttgattggttccatcttgtctgagccttacagtacaagtggctgacaaggagaagggaagatggagcctccatcttgaacatgtacagtccttagttcctgcccacattcacccatgcaagcacccagcttgtttacctatgtctgcagctcgattttacatgcttgccctttgttagaaaattatttggggctttttactaaaaagaaaaggcttaccgaggactcccatacctttactatctgcctaagtgatttcttcttaactcctgtatcattagcaaggactgaatgtgagcagccgaggggccagaccacacatccagtttgggtgaactggtgccaggacagatgacttacccgcaggatggttattcacaatactttataagcaccaaacaaaaactttttaacgtaactcaggcctctcagtgcttgagctaatcactaaacatgctgatggaggaactcactgaattacacatcctttaggactatttggtaattctttagaacatagcagatgacactatagaataattggctgaatgttttgaagtagcacttgctatgtgaaattataatggctaaagtgcctttttttgactatttatcaagagattaaaaattggaagcaagctgttctttatagagtacatcaaatgttaactttcatagacatgggttttgttttccaaatcatatttttatgaactaaaggcagactttttgcagtcccttttagcacacatttactcttcaaagtaatgttacttggaagtgtaattgtaatgagtttggttatattatgcttctttcctttaaaaaagaacatgattccctgtagggaaattcaggtaatttgcagccacagtaatcttcactatactgaaatgttaaatacttggcttttctccatgtgtttgcctttctgtactctacaagtgctatttcctactcttctaattcaatgctgagcacttgaatgatgttttcttttctccttctactcttcgacttcaggattaagttacagttggaatggttcctttgagacatctctttatttccctcttctcatcctgatcaattcatgagtagttttcaattggtgtgccctttttattgcctgttgctagtatgtcatatatatctcattttaaggactaccgatagaggcttacttaaaatgacagcaaattccagttgaaatgtgttcattttattgagttttacagagtcgtatatatgaaaggtcatcaggttcatgtaaatcatctatgcctgatggtagttgatgctttcttacagattatctgaaccaagcctattagtaatccagtcctctaacaatatgaaaaatataaaaactaaaagatagaatatggttttaaattttctaaattatggatttagatattgccttcccttaaattaatctgtaggcctattaagcagtctctactatcatgcctacagtttatagatatagaaactgaggaacctagaagccagaaaacttccttgtagtctagtacttggtaagtagataagtattagaacccaaatagtctaatttcagactgctctcttagcacagaacatgactcagtatctcactacatgactcataataatattcaaaatgaaaatatttaaatatatagtcccacttgaatttttttttttttttttttttttttttttttttttttttttttttgagacggagtctcgctctgtcgcccaggctggagtgcagtggcgggatctcggctcactgcaagctccgcctcctgggttcacgccattctcctgcctcagcctcccaagtagctgggactgcaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccactgcgcccggccgaattttttatattactggaaatttgactgggctttgagctatttatgtcatcgtttttgttataaggctgggaagcctaacccagttgctctgggccacatttctcagtgtaattgcccaagttccaaccttggcctcaccctttccttttctttctttctttttttttttaggcagtctagctactatgtcacccaggctggagcatagtggcaggatctcagctcactgcaacctctgcctcccaggttcaagcaattctccagcatcagcctcccaaacagctgggactacaggcatgcaccaccacgcctggctaatttttgtaggtttttttttttttttttttttttttagtagagacggggtttcactatgttggccaggttggtctcaaactcctgacctcaagtgatccacccgcctcgtcctcccaaagtgctgggactagaggcatgagccaccgtaccaccggtcccggccctttcttatgtctgtgatcataggtactttcctccaactttctgtgccttagcttccttatctgtataatgaacaaataatagcgtgcacagcagaaagttagtgtgggcgttaattatattaacacccatgaagtgcacagaagagggccaactagtagtacatgctcaataaacttttgctagtatgtcatttacataatcttataactaacttccttgaaaataactgcaattctcataaaatatatttagataatgtatagagtccaatgaaaagagaattaaaaacagaccaacaaaaacaaaaacaccctgagttttgtctgttgggtattttttttcttaatttatagtttttgtgctggtgtttgaactacattcttttaacttttttttttcgttttgagcaactacagtgtatacaattatgacttgccaattaaaataatattaattttaataaagagcagctgcaatggtttctaccatttttatgtcttctaaatgctgcttaatcttcagagggaaggcagccattgagtaacttaaatactgttagctctagctcttatgtgatggagaacatagagcttggtattcaggcttgggtcatctatgcactcctcagtccaggtgaagtcaacgctaaataaagtacaaagcctgatagtggacaaatgactggcttatccaaggaaaatgtgagttttgttataaaaagcaggaacagaccctggaaggtaaatatggcagatgtgaagttgcttgacacacattagcaaacatcatttgaaatgagcctaagtattactaccctttgcccacatggtccattaaactggtcagcatggctacatttcagggacagacacagctcttgaggataaagtgccaatgaattagagtaaaactgtcattctccccatattcacttgcagacatgtctcccactctcatcctcctggttcttcaatctttgtctcctttcctcagtgcaccatgttgactcctcttgatttgataatatgtttgaactcctctgacttcttgacgaaggttttctgctcagtgctgagtctgccattcctccttgattctagtaccccagtagcttcaagagaagcaaattccttccaccagccctacccccatatcctgctaggtgaacctatcccatctaatgtaaacacctgtagcaaactcctttgatgcactttcctccctctatcaaaaatccttaaggtgctggatgctctactgctgtaccatgcctaaacacctgccttctcaaattctaggctgtaagtaaaatggagaccactcaacttgcagcagaaaggctttgtcaagaaatgacaatttatatttttatatacattaattttcctttcagctacgattctcattacaaatacgcttaatcctctaatcaaccttagcaaacctctgtgattatgaattttcttttttccctaatgcccatcctaaaattttatttaacagtcactgcatgtctgaaatcagaccagccacgaccacaatgaggaagataactgaggccattgttttgctcagaatattcgagaaaaaaatttaaatatctgtttacttttagctaccatatttacatctggcattcaggaaaaaatctagaatatgtgtattgcccacaaattatattagtttctgttattttattaatattctgcaactaaaaaatatctccaactcaatgaaatcattgctgtggacagggataccgatggaattatgaggaaggacctttttggtcaggtcacatggtgataaacatcgtagcctcatatccctgcaatccttatgggacactatgatgggcatgctcttctttaagcaatatttgttcaacattgaatgcctaaaaatgggcactataggggaaagtgacctcccaaaaagactcgctcagtgatgccatttctactctcaaagggcttatattctaaatggggaaaataagatattcaggtaaaatggtatcacactggtcaagacccctttttgtcggtaaagagaatgaaggggagacattgtcgagctaaacgagtttgccactgcaacctctgagtttcattcttgaatgttcccttccattattttgagctttacattttgtaatcatagcattttccgatgagcttttatcaaacatatgtggcttgggtacggcttagatctttagtcatattcttcatctgtaaatcaggtaaatatcaaaattatgtaaatcctccaaagcaaccaaatggaagattgtaatcaaataagtgcctgcatcttatcactaagttgataaaaaaaatacaaagggctctgaagctaaaccttggagcagctccagctgcagaacattattgctttagcagagaacccagactactgctctcattctaaatggatgagatgggtaattttttcattcgtttaacgaacacacactttgtgcctgtcacaatcctaaggatacagataggcaaaacaaagttgttgttctttcagagcatacatctaaagcaggagacaaatatcaaataagcaagagacacagcaaacatcagagacggttgaaggctctgaaataagaaaattatgtgaggggataaaaagggatgggtggattgtttagataaagtggtcaaaattttttaaaatgtagtatttgaggagaaatctgcataaatagacaaagtgacacattaacatctctgaaggaacagtcattccaccaaaagaacaaaatatgcgaaaatgtagctcaaaatacgtgaaaaaataagcataacaatcattggattcatctgtaacttagttcaattatttaacaaataggctcagtcctgttgttttaaaatactatttttttctcaaagagagctttggcattgtttgaactttcccaagagtcaagagagagatgtcttgtaagcctcaatatcctccttgttgaatgctgctgagctttaaagttgcttctgctagaatgaaatactactttgagtatcctatttcatcttctcttgtctgctagatgctataatgattccccattttacagatcagtagaccaaggcaaagagaagctaagtaactctaacaaggtcaccagccacgcacagagcagcgaaatctaacaatatacaacttctattttagatggattgtcattcttttctccctgaaaacttactgaacaattaccatactgcatcatattctgaatacgaaagaagtaataagcaccatctcttctccaaattagctttaatctatgtgtaaagacaaaatcaacacacctcaaaaaagggcgcattagatacagtgcaaggtttaaaaacaaaagtgttggttagcgttaatatgagttgaatatggcttggggcaagaaaatgttggatctaaccttctttttattttcctgcccgtatttatataagaagcaattgcagagactgggatggttagcctggagaagagaagactcaggggggatttgataactgtctacaaacatttgaagagctgtcatgtggaaaagaaattagatttgttctatatgtccccaggggtgaaagtgatagaaagatttcatcacaatataaggaaggactttcaaacaaaataaggataactctaaggctctctaaagatgtaatgggctctttgagagacggagtgctctgatccgataggcaggacagccttttcaatgacatcttgtatagggaatcaagagaagggtggatggttcacatgaattttaaggtcttttctatggctgagaatttattagtttatcagtgataaatgaaattttgcccaatacttagcctcttatgaggttcagaccttctttaaagagtgttttagagagtactcttaaatgttttggctatcatatctacaactctgcatgttacttctggtacttaattgataataaataatcctcttaaggtgcactttatttcttgcttgctttttctaggtctccagccatacaccaactacagcttcactcttacagcttgtacatctgctgggtgcacttcaagcgagccttttctaggtcagacactgcaggcagctcctgaaggtaatgaaacaatatccatggtttgagggaagaaattttcacatagcattttgaggtggaatctgtaaactccttcataacaaataaggaagaggcaataaagttgataggtacaaaataaaatagcattctaggttcccattcttcaggcttgattcatgtaggtgtagcttcccaaggtcagttcgctttcaattctttaacctttatagagttgattttctgtggaaagaagaattattgaaatttttcaaaaactcagatgttaaatattttgggagcatctaatatataataagcaccatgctcactgctgaagttgtttaaaatgttctctgccctcaagactgacaatcaagtagaagtgataggagaaagatctgtatgaagagagaaaatctgaaagttgatgttaagaaagaacaaatgaatagagtgctaaggttggcctgaagaggaagagatagaaacccatcgatgacatcaaaaaaggctttatggagcagatgacttctgagatggaccacaacaaacaaggattttgacaaatgaacagtgatgtacagagatgtacaaccagacacagttggaaggaatgtaagatggaatcatcaccttagaaggcaaattgcaaatgtctatcacatttaaattgttaatttcccatgatacagctgttctattttcatcatttatgccagaaactgtgccacactgctcaaggaggcatgcaccaggatgtttattgaagcatttattttgtttaatagcaaaatgttgggagcaattttaatgtttgtgagtagaattgctaaataaattcagctattctcatattgtggaattccatgcaccagtataaaagaatgagatgatcagttcatacaaagaggaagttatgacattatattaatttataagaacaaactgagaaaatggcatttattgttaatggttaataaataaatgcatttaaaaatccaggaagtatacacaccaactgatagcaatggttacccatgtgttcagaggtgggatggctggtgtcatttactttcaaaagaaaaatatactcagtggcatgtgttagtgatcaactaattattttgttaatcttcattatctgcctatttttcatatggggaaaccaaggcataaataagtttctaaacagaaatgcaatgttaattaccaccatagactcctgaactacttgtccattactcttctaatgaaatggattgttgtacctcggaatattagacctgaacttcctaccagtaaatggggaataaaatggaaaattccacatatggggcatatggctcctcaccaggaattcactaatgatgttttctatataaagaatgtttcatgtcaaaaagcttagtgttcctttgaaaggaagaaaccagcagtggattttttggaaaggtaaactatcaaatggatactttgatgataatggataatttctaaaggatctatcaaccagatttggctgaaactcaacctgataaaataacagaatctcttgttccatttctctctaccaaattcatatatttaaattcattggaaatatgaaattttcccaacaaaatttcttgaaatgacttacattttatgacttaaaaattgtagctttcaacagtgcagggtaatgtgatatgagaaatgcccttgatttcttttttttttttaactttatgtatctttcctctaacacaaataatcatgcaaagaaataatagatgaaatggactttcctctgcagaagaaacatggatttagggccattttctggctgaataagtgccatttatatataacccatatatgaaataaatatagtgtgaatgcttaacttgggaacaccttagcaatcacattaagttctgttgttttactgtaaagtgaaaacaagtataccactttagattatccacccagacataactaattataaaatgccattttcgaagtacatcagatataatttgaagatctcatatttgagtattttaagtggacatggaaagaattaaaagaagtgtttatgcatagccaacgcaagctgagctcttttcacttgcctctcattttcaatctaagaaaaagtcaatgtacattacaacctcattgacaagttggacacagttctctacagttttatcctcatagaaaactgtgtacctgtacctttagtcaaataacaggaagattttgaattgaattattactctttttttctacaattactgccatccatgtgagttctaattcattttagagataaatcatgcaaaattgcagacatactttcctctagcattgataatgtggaaacagaaaggaaaagaagacccagtctttttcagttcattccagattcctcttcctctgcccttcttttaacgtttacacacccttggttttttcctctactctttacactatagcacccaggctcttctggaattttcgagtactggctttatctcctaatgaaggctgagagctaccaaatactaaagctctcaccaaagctacacttatggatttaaatcctatgtatttactggtctactacatgtttatatttaggtgtttttcaaaaactttaacctcagtacttcgccacttaattcttccactccactctactcctcaacttgcttttcttctctcaaatactaccacctacctatcacctaagcccaaagcttgacactcttgatggctcccttttccatatgtaatacataattttttataaaatctaattagttttaaatcttaagaattttttttaaaaaaattgttcttctttcccgtcccttttaacactgccttagttcagatcctcatagctataagaagagaagttctctggatcctcctaactaggatcccttcctctagtcatttttcctctttctcacatcccacatcctgattctttttcctcttttgacaaaataagaatatgtcatattattcacctccataaagtcccatttccttccaggaagacatacatccatatctccttagcaaagcaacatggacccctcaagttttaacttccatcaatttttcaaggctttccatcttccccacatgccatgcagtgcaccagccatgccaaggtatgtgcagtcctgccatccttgcccacatttctacgactttatgtgggttcccctcagcctgaactccctttccctacatcctcactcagttaacgctcaccttttcaaaacttggttcacgcatctccccttctggaaatcttccactacaaccacctacttcctacccatctccacttctccccacagtctgtgtcaggttaccctttctaagtgttctaacagctactgtgcctccttctcttaaagcatgtatcatactggagtacaactttttatcgactcatctttattcaccatgatacatgaactccatgaaggataagaaaaagtctttatcttcccatccacagtgcccaacacagaaaatgacacaaagtcgggtagaatgttgagtgaataaattaacaaatactaaattgtccagaattcagtgcatccctgacatcagctaatacaaaatttgttcctatcaccagatttcaggagaaaaacaatccacaataaatgctgggaattttgaattggaatgaagatttgtagggacatgagaagtgggtaatatggcatgcaactcaagataaatttaaaacaaatacagtagacatgttctacttgttgtcactgtgtaaaaaggcccaccaaggtttaattctacctttccccttttaaccttgcagctagtttaccccaccccatcctcctaggttacttccctccctactattcatttctttcacttgaactgcctcagtttgctcccttattatatagaataggtttttctggtttcacctgagacttaggccagagttacatggtgaaggggacaaattccccacctcggactcattaatatatctcaccaaagattgtcttactctagcaaagatttcttgcagctgccaagataacgatgtccccatatcaccatccaagtaaaaatgcagcactttctagttatatatacatttgaactccatattatcaatcaaaccaatgggcatggagttattaccaacttgaaaagagcttttgccagccggtataaataataaactcaacttttacctaaaggttgaaacaaacccaaaattatgtttcattttattttattagctcctccacatccacaggctttattgactggttcaaatcagaaaccaagcaatagccattctagtaccttggtgatttttaatacatcgttcaaggtgaaaaagatataactgcaggaagcagattatgaattaagattttatactttatcttttgaatcaacaaattaatatcacatttaaatcaaaactctgattggttgaatcatctagcagctgttggcagagaaacccacatacaaatgtgtactatgatttgtgaattttaccaaatatctagaacagagcagactctcagaacaaaatgaactactttcttctcaggaatatattgctccttagaaagttgggatgtttgagacatttttgaaatctatcttgtttctttcaggatgctgctaaataaattgcattttgttcttctgaaaatttttcttctaaaagtgtcaaaatcttaacctgtacggagtaacttacacaggagatacaatcaagcaaaagctattgattacagggaacctaatattgaaatgagttttttttaatctccagaagagatttacagtgtctaatcagagtataactagatgacaacataaagtggtaggactgaactttctcactgctggcttctccatcgatggatttgtacatctataagagtacttgaatgtttgacattgaattacagttgtttgtgtgtatattttattttttagacagaagtataaactccttgaaagtgagccacatcttagtcatctttgcattccctagaactgcctgcagtgcttagcataacattttgcaggagatatatttacaataaatctactcattaaacatgtattaggcattgtgttatccatagagatacattgacgaataagacagagaagatccctgctaccatggaactaactttgcatcaaagtaagagaaaggagaggactgcaccatcatataatgtaaaaataatagtatgtcaaagaaagaatttgattatgatgtcttgagtgttaagaaggaaatagaaaaggccatgcgatacagagaaactaggttgggactccattagatggggttcaagttagagttaagagagtgctaaaatgaggccttatcaataaggtgatagttacacaagtaactgaactatgagaacatatgagaacattctacatataagaacaattctacatatgagaacaaaatgcaaaaatgtcatgctgtaagggaacaaaggtgttccaggccaaaggaaccgaagttcaaaagcccaggtgtaggaaataactagaagcattctagggatagaaaggaatctggtatggccacagctctgtgaatggtgcaaagaatgctgccacttaggccagagccaataaaatgtgggaccatatgggtcacaaaaagaaattgggattatattatatgaataaattcaaaagggttatatggttcataaagatgacactggcttacatattcactttatacacttttacaaagattccaatggaatatggaaggccaagatttcgacatggaggcaagtttagaagctatgacaggagtttatgagagagagaaacgtggcttggaccaggagaagtgaaagtaaagatacaggaaagtatacattatagaatcttctgggctttatgttagattacatttgggcgtatgaaaggtgaaagtctcagggatcattatttttgtgtgttttgtccaagaaaatggatagatggacaagattgggaggtacatagattgtagacaggaaaaacaagagttctgttttgcatgtttttagtttttgatatatcatcagtcatccaaatggaggtgtcaagcaaacagttggattcttgagtctcacactcagagtttcaatctagagatatgcctttgggggtcttcagcatatgcatatttaaaacccatactgaatgaagatcacctgggaagccggtgttggaagagaagagaagagagaaaaagaagaagagaaaggaagagagaaaagcagaggggagagagagaacagagcatactgctctgaggcattacatcctttcaaggtccaggaggggaagagatcccagtaaatgaggccagaggcatagccagagaggaaaagagaagcatcacactgatgtgcaagaagaagggaaagtgcactcatttgttgaattgtataattcaggtacatactcgattatgcttactttcacatattccaggtaaattgtattaaaaagtttgaaatccccagatgatctctcaggccttgatttaaaatactctcagagtgacaaccaaggcagagaaattatccactgctagttgtctgacattcactttccaaaggcaattcaaaaataaaataatcaaagtaataaaaatatatttacaccaattatgtatttttgttccatacagttagatattttttaaaatcaacagaaaaaatatcacagttcatgggggggatggtgtgacttttgatacactgtttattttctcctaacaataaaacctcattgcgttattcttgccaggagtttgggtgacacctcgacacattatcatcaattctacaacagtggaattatattggagtctgccagaaaagcccaatggcctcgtttctcaatatcaattgagtcgtaatggaaacttgcttttcctgggtggcagtgaggagcagaatttcactgataaaaacctggagcccaatagcaggtaaactaaaagaaaactttaccaatcatacagcaggatttgtacatttctctgggttgataagaaatgcatgtcccactgaaagttgttaaattgtttaattaacttcctcattcattggccattcaataactgatgaaagtgctaaatcattcagtctttagacttcacgaaatttcttaaaaatataaataattcgtcttctgtttgacataaaagcatgagaatttttaaatatacaaaatacatgaagtattaaactttaaaaattaccaaattatcttcaaaaacacgcatccttgaactagcaataaaagagatgtaaagagttttgttttccgtcaactctcttttcttcttgtacagtgtttctctacttgctacaccacatatagttgtgaatagttttagaggaaaaagttccacatatttgcatttcattcccattcatttctcagcagagacaaaaacatatcttaaatcaacagatgttttactgtagaaagtagagatcaatttcattttattgtaaggaatagcagatcaatttaaaaacatctttctctaaacatatttccctgaactccaacctatttaaaaatggggaagattaatttgaatcctccacaatccaccagcacactccaagactttcctgaaatcttcaagaaaagctatgaattactagcaggttaaaaataaatttaagagcagctgaaattacaatggcttggagacaatgttgcctgtgcaagaaaaactaccaagtcaagtttctggaaagggggcaaagagtttgcaatttgtcacaaatttaggactaagcaattgatacaaaaactagtaatcattgttcaagtctcttgtgcatggccttaccacaattcttctttctttttaaatatagatacacttacaagttagaagtcaaaactggaggtggcagcagtgctagtgatgattacattgttcaaacacctatgtcaacaccagaagaaatctatcctccatataatatcacagtaattgggccttattctatatttgtagcttggataccaccaggtaaaaaaaaaaaagaagtatgtgtgtgtgtgtgtaaacattttaaaggaattaattagagataagaatagaactgttaatttagtaaatcagaaagacatagtcggtctcctggataaatatgaacagaaaaatctaaaccacacttctaagtgtatagacgcatgagtacatacatacatacgtagagatataggtatctagatgtcgatgtagatatgtaagtatatacagctttctatgaaagcaacactttcaagtacaagagactaaaaatctttttactcatctattttttttttttttttgagacggagtttcactcttgttgcccaggctggggtgcaatggcgcaatctcagctcaccacaacctccgactcctgggttcaaacaaatctcctgcctcaggctcctgagtagctgggattacaagcatatgccaccatgcccggctaattttgtattgtttttagtagagacagtgtttctccatgttggtcaggctggtctcgaactccagacctcaggtaattcacccgcctcagcctcccaaagtgctgggattacaggcatgagccaccacgcccggcttactcttctatatatccaatgcaagtcatataggtcagaattaccttgaacattcatttccatgggactccttagattggatcattgacattataccattccttttatattaaatcagtgaatggggagtttggaaagacagttgttcacttcacccatgtaccttgggttgtgaccacttatggtagctgcatttttcctctgtaagctgaatagccttcattgagccatttagtcattattgggttgccttgtgacttagtgcaacattatattttgaggtaagcaccatcctcaggtaaaatcctgactgcattaatactgtggagtaaagagtagagtgagaaaggacatatggaggacttttctttccaagtaaaatttaaaaatggttaagatgttaaaaacacttcaaaattatgtgactttatttttaatatctagtcttaagatgaaattgtgacacgccctttttgtcgccatcagaataagtttagccacagttcaaagtggcaccaaatggttaacagccatttgagccatcggtagatccattccataacataattaacataagcctatttttattgaattgaacagtcaaaacaggtactattgtatagctataaagagagcgtaaagacctaatacataaaacttaagtttcttatagaccaacaccttctgctataatctaagatcaaagagaaaaagttattttcccctaaaattcaaaagaaagtttacaaagagctttataagcaaagaaaaatataagttgctctaagatattaaatgtacatgatttcacccacttttgtttaaaataaatgtgcagcatattaaacaaaatataaaggaataattagtagtggcagaatgcatcacaaagtgctataatctttatgttgtaagagcatagatattcttgaactctgttcttaatttcgatagaggaaaagacatatcttctgctgtgggaaatatataaatttacagccccctttacagaatttatttctacttttgtttaattttatttatttatttatttatttatttgtttgtttgtttgtttgtttattttgagaccgggtctctctctctgtcacccaggctggagtgcagtggtgcaatctcagctcacagcaacctccgcctcccaggttcaagcctcagcctccaaagtagctgggactacaggcacacaccaccatgcctggctaatttttgtatttttagtagaaatggggcttcaccatgctggccaggctcgtctcgaactcctgacttcatgatccgcccaccttggcctcccaaagtgctgggattacgggcatgagccactgcacctggccacgattttttagtatatttctccttggcatttttattgtgctgttgtgtttttgcaccacaaaataaaatgaagctggatagagccaatctaataccatatttagcctattgacaagaaagttttagatttagaccagggtcttctacaatccaaattctccaagagcaatacgggaaatttcagggtgatgagcaaggttgatgatttctttgccatatgactgggaagtcccatggtttatcaaaatatctgttattttaacattatttaacatatcagttgccattgctaatctgaagacttcatgttcagtacgaatttgaaaatatctttattttatgactatgcaagtaagagaaatgaaaaagcctggattcatatcccaatactgccacctattagctgaacttaaacggtctctaggcctcaattttctccatctgtgaagtggagataatgatgatacctacatgtaggcaggtagggttgctgtaaagatcaaatgaagtaatttatatgataaatatattatctagttctatataatattctatagataccaatggtgattgtttgaagaattatttttttatctttaattgctcatttttaaaacgtatttgttccaacatttgctgggtctcaaagccccaattttcaaaataataaaaccacctactgaggattggattagtaaattttcaagacctctttcaaatttcccagcgtgtcatttttttctttgaattcaatatcacacttaaatgtttaatgtatcatgtttccatttagaaatgtatcattgtggaataaaacacaactttcacttgtttaatatgaccttaactctcacatacctcaggctttgtataaattgttcattctggtccagcctaggggatattgtagaatgctttacacactaactctgaccatttaaccaatggttaataaatctataatattcagacctgtcaatcttatagtttaagatgcacagaatccatttcagaaaccatataatataaggaaagattaaaatcttcaattaaatctttttcctggtgtctagaaggatttcaaactcagtaaacagtcagatgattttgacttgtgtataatctacagttgattttattggaaagtacctcatgctgtgttttgatttggataataaaaacatgtttctattcctgaatagtcacaaatatatatattttaaacagaaagaaaataaatttgtaagtggagattgtttatttgctcacaatataaagagttttctaggtattcatcatactccctgccattacaaaatgactacatcacagacagagctgaataatgggcaaaacagtccatgcctgcagttcccaaacctgaatgagcattagaatcacctaggaagcttgtgtaaagacagattctcaaccccaaatttactgaataagaatctcctgggatggagtcaagaaatctagagctttttaaaaactccacatatgactttgatgtgctaccaagtgtttttgaaatagtagcccagaggaccaaggaacagatctaggtattgctgaaaccaaatgattctgggagaacaatgtttgactgggtgtgtagtggcgtgccaagactagaagagttaattgtggaaaatggcaagccgctgaagggaaaacagccacgtgacagcaatgatctctgcagcatgaagaaactagtaactagaaagctttacctacccatccaaaaatctaaaaggaatagatgtgatttaccaaaaacatggatcacactcaccaagtgagactggtgaattacaataactgttttctctgaaaacatgagtccgccagtttctcttgaatgtctaaagcaagcttatccaacctaaagcccaggatggctttgaatgccacccaacataaattcaaaaactttcttgggatctttgcaattatttgttttagctcatcagctattgttagtgttagtgtgttttatatgtggcccaagacaattaatcttctttcattgtggcccagggaagccaaaagattggacactcatggtctaaagccaaaatactggctaaattgtatttgtttttttaaatatgcatttttttttttgtggtcagtgtgaacagagtaaccttagacaggtaagctgctgggaaaaaaaatgtctatgtggttacttggcaactgaaaaattacctaagcaattaactgaattttcagttttcaaactattgttctaatgctataaataaactaagccttagtacatgtttataagtcctactagtgaaagggtaaggtctagggaatagtgacaatacccaggggaagagtacccgtgatactgataacaaatgtcgtgtacatacgttcatattacttggtgtatttgccatttgttaaattcctactatatgccaaacactgataagctccttctctgccttacctcagttaatttttatgcaaacgctagaagacaggtaataatatcattatccccatcttaagataagaaattcgaatctcaaaaaagtaatataatatgctcaaggtcacactgcagagccaggattcaaattcaggtctactgtctgctactgccttttaagaccagttcctttctgtctttggcttaacccttaaatccaaatcgacttttcatttcttgaccaaagtctctcagatttatgatggatcaactatgatgtttgaaatagtagcccagagggccaagaaacagagctgggtgttggtgaaaaccaaatgattctgggagaatatttttttttaattttttttcttttattatactttaagttttagggtacatgtgcacaacgtgcaggtttgttacatatgtatacatgtgccatgttggtgtgctgcacccattaactcgtcatttaacattaggtatatctcctaatgctatccctcccctctcccccaaccccacaacaggccccggtatgtgatgttccccttcctgtgtccatgtgttctcattgttcaattcccacctatgagtgagaacatgtggtgtttggttttttgtccttgtgatagtttgccgagaatgatggtttccaccttcatctgtgtccccacaaaggacatgaactcatcattttttatggctgcatagtattccatggtgtatatgtgccacattttcttaatcctgtctatcattgttggacatttgggttggttccaagtctttgctattgtgaatagtgccgcaataaacatacatgtgcgtgtgtctttatagcagcatgatttataatcctttgggtatatacccagtaatgggatggctgggtcaaatggtatttctagttcaagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgacttgcatttctctgatggccagtgatggtgagcattttttcatgtgtcttttggctgcataaatgtcttcttttgagaagtgtctgttcatatccttctcccactttttgatggggctgtttgtttttttcttgtaaatttgtttgagttcattgtagattctagatattagccctttgtcagatgagtagaatgcaaaaattttcttccattctgtaggttgcctgttcactctgatggtagtttcttttgcagtgcagaagctctttagtttaattagatcccatttgtcaattttacctaggcaataccattcaggacataggtatgggcaaggacttcatgtctaaaacaccaaaagcaatgggagaataatattttactgggggcatcaaaaccagaagaattatttgtggaagtggtgagcccctgaagggaaaatatccacattgcaacaatgactttttgcagcgtgaaggaagtagtaaccagaaagctttacctacacattctagaaggaatagacgtgacttaaaaccagattccaggtgtaggaagattttagttaggtgggaggggaggagagtcacttctcaaattgctgtaaagagatcatccaaattctattttaaagccttggtaaatattcccctgtctcccatgtaaaccttcatccactttaccttattctttcttgataaatgtcagtagtaacattaccaaaacactctaagctctagaaaatcaagatctctagccttttgtgtatcatttgaacctctaaatcaggtgacatacaaacaacatatccttataaaaattttgctgaattaatggaggaacacaatggtgagcgagcctccacaatttattatgcagtcaaatgtaaattgtggatatcctgccatttaaaattactcaaacatttgattttctcttaaagtcatccttcgtctacattaacttaatcttaaacagagacatacacacaaagagagagagaggcagagagacagagagagagagacatttcttctttaatgacaaacagagcacatacacatattttccaaagactgcatcttgtcttatggatgtgcaattttttcacctttcagaaaaggtggtattgttttctaacatggaatgggcttcactatttagttgtcctctggccttgggcaagctgcacaatgtttctcaaattcaggtttctcatctgtacaaggagaaattaaatgcctaccttatattgttatatgaagtaaatgagatggcatggtaaaactccattattgtttgaacctttaggtaatgtaaacaaccttagattattcctaagcattccctctcaccttttaccagctctcaacattgggtcaggacttttgtattcatattaaagagaacatttatattaaagagagcaaaggatatatgttaccttaataggtgaaaaattatggaaaattaaatagcaaatgcttcatggaacataagtggtttactcagaatgacaatggagatagatatccctgctgtttaagaatctaaacattcaaaattatttaaactctgaaggtaataatgagtctttctaatttatcgagatgatgactatattttgaactgttctagcccttaatcatgttctaattaacaatgccattgcatttaacacatactttttctcactaaggatggtgagtcatttaggtttaacgtacaatatagaaatactggtgcttttcctttaacattaatatcttactccattaaagaaggaattagcaagaattctactgataaataatttttattaatattgctctagaaatacaaatttttttatttatcattttgattaaaggttagctggccataatatggtctatttatggacattagacatcttggcattcagttaactcatcagctgcagtgtattatttcagatactatgcatttaaagtcaaaatttacattaatctttctaaaggattcacattacattaattgggatgattcaacattgacagttgtttcacttttcttaacttataaatgcaataaccaaatgacaaggagtggtgagtttcagaagaaaatgtgaaactcacttcagtggtttgtattttattttggatattttaaaatgtatctttcattactgagctttaatatatgctaggcattttgctaagagattaacatatatctcatttagtgttcataataacttaatatagtatgtcctattgttttgctcattttactaatgaaaaaggtcaatttagacactccaagctattttctctaggttattcttcaagcaggtgtcagagcagggctgaccctcatgggtgtgagtccaagtctgactcaaaactactattctatattttctcaatatttttccacctaaacgtgcggaaagcaaatgatttttcatgagttctactgtaatcccatttaaaagctaaaaaactgatttttgctttatatataggaagtatgaatgaggacaatgtaattcaggatcagtcgacccagtaacccaatagaataattttatttgtggctcaaaacttcatgagatgtaattcatttgcctttgggtatattgattcctctagtcatttaactaacgtggaaattatttctgagccccactcaggggcaaaacatgatgctggacaccctaaaagttacaaagaggaatgagacactgtccctcttgtcaggaaccctaccatctagtaaggtagaaaagacataaatgataactattatacaaccaatgttaaatttccatacaattggtatgaatgagttcaagagggtcccgttttacttctgttcccccaaaaaggcctaatcaaggtttccctacctatacagtggagaatttagctcgatttgttaaaagcaccatgttaagtgcaaccaagtgttttgaaacaaatgcctctatcaaaccgaattaatagtttttcctcttagaatttttcctgttccagctcctaaaaaaagacttaaaaaggattattgattgacttgtcccattgtaaagtatgcacctgctgtgaaatgaagccatggagaaaaatagttgaataatttaacttttttatttgtaaagataatcagggtttttctgattacatcttaacttcataaatgttaaataacctatcagcatctagttgttgtaaattatgaaaaggagcattgcaaggaatattaaccaacgaaatccttgttctttagtgaacaagaaaatgtgttatggcagcttgtcattgtgcgactggtaactttgacaccaaataacaaaactgccatttgcacttagggtaaattggttcacttgagcttccactgctcctcttgctctgacataaatttatgaactcaggaactaaccaagtcgtgtggcttcccagctgactttaacaaatatgcccatttcatttcatttagtcatcagaataccagggggctcagtcatttcagactcattgcagatggtatagggtttgtaggaacaccagagactttcgtgtcacagtcctggaaattatgatagtggagggggcccactttcctaaatgcatgccagtgttttacgtgttcacagcttagaggagcattttctgtttcagcacctcataggtatatgtaaaggacatttatttccaattaatgaagaggtgaaaaatacattttctatgctcatggtttggctagccatgtttaaatctggattaagattatgtttatatttgacatgcggtagaagcacagttttgttccttcatcctctgggagtcctgtcctttttataacagaagttacttcttgaaggatgcaaggcctggaagcagaacagtaggtacagactgaagacataaagtaaaacaacctcagatgaattggagggaacgccactccaaattactgctaacaatgaataatacagtattttcgtaggaatgcaatttgatcatatccaagtacacataaaaaataaaactagataacaaaatagtgttacaaagacattaacttgaatgaatgtaacatttatttgtagttggaatagcaactttatatgaaagatggattcaaaagtgtttgagggcacatggaaacagtgccatagttgttttttgttctttatttcattttgttccattttgtcttgtagagatgtcagccatttattaagtactttctatgttatgggaatatattgaaaggcttacagatattttctaatttaatcctcacaactctctatgaggtagctattagtatcatcattttacacatgaagagacaacatccatagaggttagttaatttgccagtggtcgcttgggaaataagggcagcagaaggatttgatctatctgacaccactctgtggtttgtctagttcaacaagaatgatggcatgtttcttatgaatgtgtgtctgtcaaacttttctgcaagaactgtcctaggaacaaagaagacaggatgaatatgcaatcccaggaggtctgaaaacagagcctgaagcaatcatcattagcttgcagtttctttaaggtcttgctttttatcttaaaaattcatgtaaatttgccattgtattccagtgtttgtcttcatccaaaaaataatatattatacaacttatcatttgggaaaacattttctactaatctcattggctaaagagtgataatgctgttatatttcatgatattaggaagatctaaagaaaactaagcccaataacaggttcaaggtcccggcaattcttcccctcttcattttgtcataaatatgtgggttcaccgtgaggcagaggttgcagtgaaccaagatcatgccactgcactccagcctggtggcaaagcaagacttcgtctcaaaaacaaaacaaaacttgggaggccgaggcgggtggatcatgaggtcaggagatccagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccgcagtccggcctgggcgacagagcgagactccgtctcaaaaaaaaaaaccaaacaaacaaacaaacaaaaaaaaacaaaaaacctgtggcttcaaacaacagccttttattcctcactgctttactgttatggcagggtaacaatagggagaaatgcccaaaatgtgatatggaatgctttgtcattctaggatactctggatggaaatttctatcagcatatcctcctgctgaaggtcaaattgcaaactgagagggtccccgattccttcttcaatctctcttaccacctcaagcaacaccctccaaaaaatactttttgcggagaggaagaagaaacctgattatattactttttattttacctctggcacagtacttaaatttttctcatccattaatgaactgagtctcaaatggtctctataatcaattctccttatccagctctcaaatttcattttaattattgcagtcttgttgagagcagtaaaaactgccagttttgtcgtggagtggtgaattaggcctcgaagaatagcctttaaataggcctattatgtgtattcaccataccagtaaagagaaaaataaagttattttttaggcatttaatttttgttatgatatcttttcctgtttctttatggagaaaaatagtatagaactctttattacctgaaacaaagtggaagtgtcatgggtcaggccaacttttcatcccatgtctagggtagaaaatccacattgagttcactttaaagcaatagcgagagactaacattacattgtcctttggttacagtatgaacagttatacttgttcagcacactggcacatcagcataaacattttcttgtgtcctacagttggttcattctgtggtgactacagagtcttcaactctacaattggctagcaaaaattctaatcactcaccatacatacaattctctaatcttgaacttttagaaagaaaaattcacacccaatttttgtgaacaaagaaacggggattctgctggttccccttcctcaaacagggaaatcctgtgtttcccaaattttccatatcaaagtgatactccaaaaaaaggcacagtaagtccttaaggtcatgataggttcttggaaactgcaattttgagtcaaaagatatataaggaaaccaattttaccttaggctagttgatataagcaagatttaagttgcaaggaatatttgtggtcacaaaaacgtcaccaaactaaatatcatcaaagaaagaccaaaacacttctaatattaaactgaaataaatatgagctatacatacatttaagaaagattaatagaaacaagtaagatcatttttaacctaagttttggcaagtcagcgagtgacaacagccatagggataaatgtttttgagcagaaattagaagaaattcttcttaccaccatgcactagtaaaaacaatcgcaagtagggcaagctcacagaaggcttttgtacagcattatttattattatgcatctatatgatagtaacacacttaatgaatctttactttacaattattcattcattcattcattttctgacacaccttttccagttcagggttggggtggccagggcctaaccaggcagctcaagaccattccgttacagggcacacacacacacccacactcgctcagactaggaccattcagacacaccaattaatttaatggaaacatctttaggatatgggaaaaatccagagtacccataaagaaaccacgcagacatggggagaatgtgtaaatttcacatagacagtggctccagctgggaatcaatttttttcctcataaatattaatgaaacaatgttgaatgaaacaacattattcgaggacctacggtactatgtttgttcctgtctttgaatatactttgacatgagcccacaaacctccaaagcaggtgtatttcaggttgggatacttggtctgcagaactttaaatttctacctataatatgcttgttccatcagtaatgatttttacttatccatcatttgtttccttgcttcggaatagtctccaagaatggctctgccttactgcacaaattttctcaaacctatcttgtcatttttccccaagttgtcctactctaagactccattatcaaggaaaagcataagtatattgatataagtgttgatatcagatgggcctaagttcaagtccttgcttctccaattaatcagtgtgcaatctggaacaagttatttaacttctctgagttttagttttctcatcttaaaaaatagtaatatttaccatgcagtattgtcttgagggttcgttcattcattcaatcagctaacatttattgagctgctactttgtgctaaagtctaggcagtggaaccacattggagaaaacaaagtcctaatttatacggttgacattctagtagtattaaatgggataatgcgtgttgcctggcataacacagggatgcattgaaatgactcttgtttgtactacttctgcaaacattgtaagactttcaaactggtttccctatgtcttgtctctcatgtttttaagccactattcatttcccaacagtgttatcattctaaaatataggtagactcttattttcttatttatacctgcaaagtctccttgttgctgattatatatgaagcccaaatttctcaaagaattaattgataaaatttagtagtcacttgagttttggagtgaagaaggcaggatccactctaaaagtcttactctaagatttccatcctaggaaaatgggaagatggtattatgacttactgaaagaggaaacctaggaaaaagaacaggtttgggagtggaaaatacagctagttctgttttagaattgttgagatcgtggcctctgaggaatatccatgtagaaatacctagcaggctgttgaaaatacaaagctgtaataccggaaagatagaaagctagagataagagtttaggaatcaatgatagaatgttagtagtttaacctactagaataaatgtaccagatagtttagccatgatgctctaaatttaaaataaacattctcagtctaagctgccaaatttaacgcaatctagcacctttcctgaggaagcaattgatcagtacttctgaagatgatcaatatctccttcagacacctctttttcatctatcctacacaaaatcctgagcatctttggtttgtaccagctcttccactctgtaaatacagaggccacatctataaaaagcaaaaccacatttcattctttagacctcatctctcttaggtcattgagtcctgtgcttcctcagtaatgttatctctagattccactgtttctaaagtaaagatagacttatgtgggtactacagaagtaaataactaaactcataaatgttaaaaactctcagatcaaggagacaatgtaatagaaaatgccattatattcttcattcaaaactcatatcctctccttgaaaaagtatgcctgttgttcatgaccaaataaaacttaacaagcatttaattatataaatagactttgacgaggctaaactgacaagacctactttctttaggaaggaatggtgaaaaatgacaattgttgaacccaaattttcgctgtatttagggccataagtctcactgacagtgaactgtcctggcccaataattaatgcactgggaattctctaggtagaccatgatttggatatttcatgggctatgtcaaggatccatgtcagacaggaggcatacacaatgctctacagaaaaattattgtcacaagcaaaattggtgttgttttctatgaactttaaaagtaagtaaacctagaaaaaatataggacagcataattgccttatatgttttaagtgaaatgtgccttcatttttatttgccaatagagtatatctttaaatagaaatattatgcttttaaaaatagattatgtacatttcttacttttggaatacacaatctaatatttgccaacttaacttttgtgaagcttttaattgctatattaaaaagtaatttacttttctattacaactttttttttttttttggaggcggagtctcactctgtcgcccaggctggagtgcagtggcgtgatctcagctcactgcaacctctgcctcccgggttcaagcgattctcctgcctcagcctcccgagtagctgggattacaggcacacaccactatgcccggctaatttctgtatttttacagggtttcaccatgttggccaggatggtctccatctcctgaccttgtgatcagcccacctcaacctcccaaagtgctgggattacaggcatgagccaccacgcccggcctcaattacaaaattttaaatagacattatttttaaaagacaaacatttgttgcccattctgttttatttatatatatatgtgtgtctatatatatttatttatatatatatgtgtgtctatatatatatacacacacacacacacacacacacacacacatatatatatatatatgtttttaatgttctctctctctctctctctttaaagggatcctcatccccgaaattcctgtggagtacaatgtcttactcaatgatggaagtgtaacacctctggccttctccgttggtcatcatcaatccacccttctggaaaatttgactccattcacacagtatgagataaggatacaagcatgtcaaaatggtgaaagtctttcagacacttggcctgggcttttatgaaaaagtatttcattaaaaaatttcattaaaaaggaatacattctcagtccaaatataaagactaacgtttcacttcttatttgtagtggactgtttacccagaaaaatcacagtctggcatcgagtaaagcattatgcatttctgcacattaaatcataaatatttaaatatattaaaatggtggttttgcaaagtcttgttttataaggccctttgaaagaaaaacacctagctcacataaaggagtctttggtaatataaaacaaaaatgagtattccaaatatttcatagaaaacatatttaccttggccttatttaaattttatccaggaggaggaagtgagaagttatttaagagttgaattacacccaaatgaatcctatatattttatagtgcttccttgaaccctattcatatatacaaactatcaccttgtgtttcatggcttaggctgtggtcagtgaaattttcatgtatctgtgttgtgttaaggaaaagcctcccccatttcctttatcactccaaacggataagtagctaaatgtaaactgtgatttaggaggggagaacagggaatcaagagagctatacatcattttatttatctcttttaaattaagtataaactttaacagatatggatatgttatatatgtgtatatcatatataacatgatatatgtgtatatcatatataacatatgatatatatgatctcatcatatatgttatataacgtataatactcatttgctaaataaagaaaacatgtaacttaccttagtataaaaaacattttgcttcaccttaaagaaatttatcagactcaatgtgtagtggaaactcctgtattgaatgtccttaggaatttctgtttccaaatagtgctagttctcatggagttggttagaattatgagtctgcaattttgctctgctgaactcatcagaaatggctagtcagtttgtccttttttctctaaaaaatagaccatggcatttttgtttgaggggtattgctttctctgatctgtcttcacctgataaacgtgaaaataattttaaattaatgttttcttgactcaagtacaaagtcaacgtctgcatctccgtgtccctgaaactgtgcaatggaggtacaatatccttcaaatagattgttttattcctgtgtgtttgaataatgttcatgagtttaaaatattggcaaaataaaatattattaaaagcatgcaagatgtgtaggtcacacatacacttgtgaaattcaagtgcattatcactttctggttagaatgactataataaactagagaaacttgagttcagacaagtttccttattattccttatttccagacaatatgccttattgtttatgtctatataaatatgtgactaattaatgggttttccaaaaataattttctatttaaatgttcaaatcccataaaaatttatttaaaacacatgtacaagtatatatgcaaaaggacaggttaaaataattttcatgatatcattacccttctgtatgaatatgtagttcttttccttgcttgaaaaataataaagacctcaattttttttttttcaaggaagttgtggagttagcagtaggatgtttgtcaaaacacctgaagcagccccaatggatcttaattctcctgttcttaaggcactggggtcagcttgcatagagattaagtggatgccacctgaaaaaccaaatggaatcatcatcaactactttatttacaggtaagattggctgttactattatttttagttatttaagaatgcgtactgctccaacacagcagaatcaagagcattttatatttccataagagaatgaatgggaattcatgttgtgtttttttttgttttgttttgtatgtttgtttgtttgtttgtagcacctaccagtgaggactaagactggtgctcaaacttttacaaattaaccaaggaaaaaagccataactgccatataacatttttgattgagatctgtttgaaaactgagaccttatagcccacataggcttatatttagtgatggggcagaacagtcctctaaagcaggggttcctaacccccaggccacagagtccgcggcctgttaggaaccgggccacacagcaggtgagtggctggtgagcaagcattaccaccggagcttcacctcctgtcagattagtggtggcattagatactcacaggagtccaaaccctattgtgaactgcgcatgtgggggatctaggttgtgccttccttatcagaatctaatgcctgatgatctgaggtggaataatttcatcttgaaaccgtacaccctaactgcattgccccagtgtgtagaaaaattgtcttccacaaaaccagtccctggtgccaaaaagtttggggaccactgcttaagcagctcactgaccaagaaaacatagtctttccagagaggaaaccagatacaagacaagaattctaatatttctcattaattattatgtagagattaaaaagttttttctcctcctccaaagatggtgcttttcataagcagaaaaaggggctctcctctccagttttccttctgttttaatgagcctccactccactggttagatggtgttatagcaacttgttccatcatgtgcagaatttattaagtgtacctacctaaaataaagaaaagagacaatagggaagagaggaagagaaagattgaggaaaaagagagacaaagagagattgagagagagagagagaaaataatggaagagagagatacactatgaacattttggtttgaaggatattttgctctctgatctagtcttcaccagatcaacatgaacattgctttaaattaatgtattctttaaataaataatgaatgaggaggagaaggagcaggcaaaggaagagaatgagggagagatggagggagggagagaagaagagaaaaaatagagaaagtgaggggaggtgagtagaaagtacaatgcaaagagccaagggggcaaataacctgtcaactgatggcttgctacttaagacagaaaatacaatcattggtagacatacaggacttgcagattgaaaaacccaatcccattctgaaagcaatgtatttcctttagcgtacaaagcagaacacccttcttctcagatcctcataccccgcacctcttcaacatcctttgttagtgtctctagcagcctcaggccttcccttatttggtcctatgccctggaaacttagtgaaacttacttaggctcctcttataactttagatattgaaatcctttgattcacatcagtcttcagtgatgagctaagggcttatagaaaaaaattacgaaaggagaaagtattattgcatttctggttatgtaaatgacattaccaaaaatgaacaagccaaatttcttctcagcaaacattaatttgaagaataatatttctgattcaaaaacacatgaacacgtaaaaatggttaatgtgaatttccattttacgctaagcacattagtgcaggctctaaaatgtccaccctcttgaaatagttttctttcatccacttaatgctaattgcatgagaaaagcacatcaaattcctattcagaataaagggaaatagagtatctgttatagaccaggacgtggcttcactctgttggttttgtaaataaagctcgtgattacagtgcctattccatggcagctatagagagggaaaacaggaaatataatgcagaaagcccgcttcaatgaaaaatactgtaaattgaatttgacagcatttgatggcatctgattattctaatcacagccaaacaatgatataaagagtaatatgaaacagaatgtgttactgcctagcagactcaaaagcaataaaccttcctccaatgtgacacaatcacttcacaatcataattgtagcctgtttgatacctctgagtacagcagaagggcactgactgacatagatacattttgttttttatttaaagtgaaatgaaaatggcgcactggggctccagatacaatcgttatattcacctacataggcatgaatcacttggcagttatttcaactgaagtttaaatgtgcttagacaacaacaatatcaaatttttcttagatagctgcaaaaaataatcagaaatttgtaaggacagaaatagaatggagacacatagttctttttcattctgagactacatagagccctttatatagttatagccaccagcctgcagtatttctgaggaggttatggcatgtaatttcagcttcatcattggccttctctttcttctatcggcaccaaaggaagtacatttagctcaaaccaaagataggatttggcctatgcagatatttttattaacttgcaggaagcccacttgtaaatctcatttgaaattgtttgccactctcttctcaccaagaccctgaatcattttcttttctgtaactgtcctttattttttaaatatttcctctagatattatcctattaaaaaatatctgacctaataaagacagaagatgtttatgacttcaaaaacaaagcaaaataacctaaatattatcctattaaaaagcgtctgccctattaaagatagaagaatgtttataatttcaaaaacgaaacaaaataacctagtaagaacaaactattaatatgattccctctgcttagtttatctgtttaagctattttgttgactatatataagtcacaaaaaaagatttgctacaaaaagttttgtaaagaatagagaccaacatttaagttagtgttttgcaacctgtttattgactgagtatagacaagactgtcttggacatctgcttcctcctctcaatgagtttggctggtatgataatgattcttcagtattccccctttattttatatctgcaaccttgcaaatggcaaaaatctcatcacttacgtctacaaaatccatcaaacacattaaattgagactttacaaaacatgtaataaaataatctcctcccactaggtgctttaattttaatagaaaccaaatttcatggggtttattattctcatgagctttctctttaaataaataaaaagatttgatcaatgtgcactgagaggcaaaactatatacaaacaccctgtaaatgctgtaaaaatagaaacaaatgatggcacttccttctgagtatttagtaagatttaaaggataaaatctgaaataattttgaagactgtatgatatgaaagggttttcaaagcagataagtgaaaacattttataaaatggataattaagctgattgaattaactaagaaaagacgagcattgaatcaaaggcaaaggaattttgatgtaattcaatttgtattgggtggaaagatggatatagatatgaatatttatatagatagatacagacagaagacagacagacagacatctacctatccatacatgtacatatctactgagagagacacaaagatctatgagacctaagcccttttaccaatgatcttcactacagtgggagatataagacaggctaaataaacaaagaaaagagtaaaatatatagtggaaaaacagaaatatttaccagaaaatttagagaataattctgtgtctagaatattcatggaacacttcatcaagttgatgtcattgagactaggacttataaaataaagatttaatgactatttaaattgtaagagaaatacatttgttagaaaaaatgttttaacagtacagaagattactaaggttattattcattcttatgatttactcatggcatatgtaattttcactaatagaagtaacactattaattttaatatattaacattaatgttttctatttgtattttcttcttcatgaaagaattatattgcccatattgttctgcaattttctttgggcattttatatatatgcccacacacatatacacacctaatttcttttaatgactcatcaatattctgttatatggatgtgtatcatatattatttagccagtaccctgatgatggcaagataggtgattttcaagttttcgttaccacagcaattctctaataaatattcttacggtaagtatacagagaattattcttagtactagaagtactgggtcaattaaaattgttgaggatttgtctttactagaccatatgcatttaaaattgttgaggattcctaagttgtcttccaaatatcatatgtaagaatttctaattctgaaatcttttaatacagggtcagtcttccaaatctgtcagctcaatattttcatttgcacatttttgttgttttaattcaagttttgatgattataagtaagattgttcatttacttaaaatatttatcttctatttgggaggggtatgtataatatattataaattcttagactaattttttctactggattatttcttattgtctatattctttccacattaaagaaaatctccctttcatgatcatattaaaaataacacattaattatttcttccagcacttttatggctctactccttatttctaaatatggaattaatattgttattggaaattagataagaattcattttcttaaaaaatgctaactagtttatcaacattatttcataatccactgatttgaaatgtcactcatacaaaattcctatgtgcatcgggttcattttaggactttgtattctgtttcacttgtggtaaatagggattttaacaagtacagcctgatggtgaagacatgataagtgaataaaatcaatagaataagcaaaatttccaacacataagcataggattcaaggaatggtcaggtttatctggagtcattgctattagtaggggacatttagaagatcagcttaatgatagattttagatctaaggagtttaggctttatattcagaggcaatgtgagctgctgaaggtttagggggtaaatagagaagcaatgtaataaagtggaaagagtgtggcatttgtagtcagaagatatggcttccagggcctggctctaacacttactagttatatgaccttaggcaagtcactgtgttccctaattttccatttttacatgaagtgaagatagtaaatataaaagataattagcctcttggaattctgtaagaattaaataatatgtgtggaattactgttaaatgtgaagcatgataaaaatagaaagttatcctagatatgttgtccaaagccatgttttagaaagacaaatccatctggcagttatagatgtacatttaaagtcaatgaaagaggttcatggttataaaagtagcagcttgcataacagtatgcctggtaggattctgttttcctttaaatatatagtatattttttacatatatatgtatataaaaaaatgtctggaatgttaaacaccaaaatagtgctagcagtgcttatctccaaatattaggctatcagtgattcttttaaatacttctgcttttgttcatctgtgttttcttattaatttttatagtcaatacatcatatggtctagtaaagacaaaataataaatttgtgagcccagatgcaaatctatcatcactgtctccgattttcctatttccttctttgtgtgaatatcaccatcactttctgtaataatcaaagtctgatcaagaaagaggaaccacactacttactttaacagaaggaatttaatataaataattagtaagtagttataaatttgttaactaggtaactaaaagcataaaaagagaactctaagatatcatggaggtggcaactacaggaaacagctagcacctttagaactgagggaacaaaggggagttgttagaattattaaaatgtaaatgcatagaggagggtgcctgtgaagctgggactcagacagttgaagaggggtacctgccactggtgcagttgtatggaggaggaaacatgaaattaagttggttttccaaatgtcggaaaaattgcatgctgcaatcacttgctcccaaggtatttctttattgcaacacaagaacagcctaatacagaaaactggcaccaggagtagcgtgttgctatgaagatacctgaaaatgtggaagtgactttggaaatgggtaacgggcagaggttgaaagagttgggagggctcagaagaagacaggaaggtgagggaaaatttggaacttcttagagactggttaaatggttctcaccaaaatgctgatagaaatatggacagtgaagaccagactaatgaagttggagatgcaaataattgagaactagagtaaaggtcacccttgttatgccctagcaaagaactaggttccattacatccatgccccagggatttgtgaaagtgagaacttaagagtaaaaacctagggtactggtggaagaaatttcaaagcaacaaagcagcattcaagactttgcctggctgtttctaacagcctacaatcagatatgggagcaaaggaatgactcaaagttggaacttttatgtaaaagggaagcagagagcaaaagttcagaaaatttgcagcctggccctgtggtagagagagaattcaagcagactgtggagtgaccactttcaagagagactagcatcactgtaaggtagccaagtgttaatatccaagataatagggaaaaggcctagaaggcatttcagagatcttacaggcagcccctctcaacacaagcccagaggcctaggaggaaagaatggttttgagggccaggcccagagccctgctgccctgtgcaggcttgcgaactgttccccacatcctgactactcttgctgcagctgcagctcgaagggcctcagatacatcacaggtaggtgcttcagggggcgtacaccaaacccttggtagctaccatgtagtgttaagttggcagatgcacagaatgcaagcatgaaggaggcttggcagcttccccctagatttcagagaatgtatgagaaagcctgggtgcccaggcagaaggctgccacaggggtgaagcccttacagagaaactctactagggcagtgcagaaggcaagtgtggtgttggagccaccatacagagtctccatcagggcgctgtctgttggagctgtgggaagggggccacttctctctaggtcccagaaaccatggacagcttgtatcctgaaaaaagccatagggattcaactccaatatatgagagcagccacagggtctgcactctgcaaaaccacagggttgaagctacccaaagccttaggagtcagtgcttgcagcagtgtgccctggagtgggacatggagttaatggagactattttggagctttaaggtttaatgtctgtcctaccaggtctcagacttgtgtgggccctataggccctttctgttagccaatttctcccttttgcaatgagaatgtttacccaatacctatatccacattgtatcttggaagtaaataacttgttttgattttataggcttataggtgaaaggagatgagtctccagatgagattttagacttggtacttgagacttggggcttttgagttaatgctgtaatcagttaaaacttcggggaactattgggaggacatgatttcattttgaaatgtgagaaagagatgagatttgggaggccagtggtggaataatatagtttgtatgtttgtcctctctaaatctcatgctaaaaacagattcccaatgttgcagatggggcctagtgggaggtgattgcataatggggtcagatcccttatgaatggtgtagcaccatgcccttagtgataagtgtgttcttgctcagtttgttcatgatgggagatctggttgtttaaatgtctaggactccacccgccccccgcccccccgccacctctctctcttgctcctgctctctgcacgtgatgcacttgctctttcttcaccttccatcatagttgtaagcttcctgagtctctcataagcagatgccagcatcatgctttctgtacgccctgcaggactgtgagccagttaaatccctattctgtataaattagcttacctcaagtatttttgtagcaatgcaaaaggagcctaatacaaattagaaaaaagaggtagcacatagaaggatatgataactcttatttgagagaaaagcaaggaaaagactttctggaaaaagtgatatggggctagaattttaaaagacgagttgtagttagtctatagaaaaaaggagaggccaggtgtggtggctcacacctgtaatcccagcactttgggaggctgaagagggcagatcacaaggtcaggagatcgagaccatcctggctaacacagtgaaaccccgtctctattaaaaatacaaaaaattagccaggcatggtggcaggcacctgtagtcccagccactcgggaggctgaggcaggagaatggcgtgaacctgggaggcggagcttgcagtgagccgagattgccccactgcactccagcctgggcaacagagcaaaaaaaaaaaaaaaaaaaaaaaaaaaagaaagaaaaaaggagaataagaaagaggattgggagggatattgccagagaattagcagataccaaagccatggaaccgtgaaatataatggaatataagaaactatagtcaagcatttgatgataactagaatataaaatgggactagaaatttcagaaaggtgagtccttttgagaatcagcagattaaggataagcataggccattttacatggtaaatctctaaagaatttttaaaaggactgtcttaaaatttttgaaaggtttgtgatgtctcttccctcaacagccaagtctctactcacaccaaaaacttgacgattcaaccttcacaaatcattttgtaaatcacctgtgtttccatttgtcctctcagcaatctagttcagggtctgcatttattcttacgtaaactgttgagatgacctccttgttcaatgccagatgcacatcatctccatgataacttcattcagatcatgcattacattttacccaatgatttttatgttttaatttttataagaattttcagaggtttgttatactctatgaggttattaactccactttacaaaatgaaatagaaactagaggacacagacaggcaagttcacccaaggtcattgaactaagtggcagagccaggacctccaacctatctcctctgactacagatgtttctgattatctatttaaactcagaatatttgtaatattcttcatggaatggggttggcagtttcataacctcaaaattgttatggtgcattgggttctaggattttgttttaattgcttttgaaaataagcagtgacaattgctggaggggagagaaggagtaaggagctcctaaaagcattgtacattgagaccacagaagtgtgactgcctttaaaaatatatggttcctagtttttatacttatttttgttttcctcttagtgttaggcaacattaaattaactctagttggaaaattacattcctgaagtatctcccaaatgagcctgagcaaagaataaccatttggctattcagagagaactgaaaatgtgatttctctaaacacaggctactcaggaggaaacacttccagttaaatgaacaggtgatgcttaaatcttaaataattaggaataattgtggtctactcaaccacttctgctctaaatgtattcagacataaagagagactctgttttttagcagtgcagatgggacatgtacttctccacgatattaatttttcaaggattcaatagcgataagaaatacttaaccaggctgcaccttttaattcttttggtgaataaacttgaggccaacataatactcaatcttttaaatagtatatgtatttaaaaccccacttttaggcaaattttgttaagaatgtcggctttatagaaaccatgactacatctcaatttgggaattcgtgagagtttaataaaaattaattgaattgtcatggaaaggctgaagctagacaaaatagaaaatgttacttccccatagaccatcataggtttgtttgctgtattgtgttcctagcaaacaactttttaaaaatcactgagaagagtccttggctatgagccctgcagttctcattagaatggatctctcccaatgacacacctggtacctgatatctgtagcaagtacaaaggccaaaccctgcaaaccttcactgagtgcagaatctggttcacgcatggtagtgagcaataatgaggtgggctgccgaaccataattgcaggtgactgagaggtgtctatgaagcctctatagcttccagcatgaagcttgtcattgctcatacttaggtcatcgtgatttatcaacttaaggatcatcagattcccaaagccaaagattttacatattctgcctttttgtgaaaggtaactgtcattcactttgtcttaataaccctttacattttgatggagctggttaatctgatatggcagcatgtgaatttttcagcatctgaagagtgtgttaattaaatacttctaacagcctggaaaatattactgtattcatcactctcttctcaactagagagagagctgaaagaggagggtcaatgtcttggttacattctctcccaacctggaatactgccctgataggaaataagagctgatggagaagaggcaaagatgcagggaagtaatgggattccataacttttagcctttcacttgaaaaacatgattgaacacttactgggctcagatgctgggaatatagagatatgccaaccacagttcctccagaactttgctttccatcaaacctgcatcatgtttttacatctggatgagaaaagaactgttccaaatgaagtatcagatatatagggccgtctcaacaactcaccattccatttctcttacttctatatttaatgctatatatatttagtaccaaaagagtatgcatttggccctagtttccctatcaacaaaatctaaagatgagcctaaacaattccatcctcagacagttgaaagaattttggggtcatactctgcattttaccaggttttggggaagacatctaaaaggaatttgacttttgtcctttaaaaatctctaaagcaagccagacatggtggctcatgcctgtaatcccagcactttggaaggccaaggccagaggcttgcttggggaagaccagcctgggcaacatggcaagacctcatctctacaaaaaaattttaaaagttagccaggcctagtagcacacatctgtagtcctagctactcaggagactgaggcaggaggatttcttgagtccaggagtttgaggctgcagttagccatgattgcatcaatgcactccagcctgagtgacagagtgagacccagtctcaaaataaataaataaaacaaaaaaactctaaaacaaattcctattatattacttatcatgttattttcattaatctgcacatagctccatcttctctactcagctacctattcctttaggtaaggggtgtgttcatctttttacccttgtttctaatacaatgatgggcatataacagtgcttaataaagttgttgatgtataagtacaataaatgtagaaaaaacagtggtcttgatgtataagaaaagattgtccatactttgagaggttatggtttaaattatagaagagaaaattcaaatgaagagaaattaagtggcatctaagaagtgaatttaaaatactttgtaaacatcctgggaacaattgcaaaagagcattgtgctgcatgagagaaaataggaactgtggacttcccttcatagttcttcatcatccagtatgccaacctgggctttttcacacagtaattttatggtcctaagagcagcaaaaggatcatcctcaatgtgcaaacacttttgaagtctctgcaatcatcatatttgctactgtcccatgagccaaaaaagtcatatagccaagctcagagtgagtttacgagcatactcgcaaaaggcctggatacaggaagacaaacacattgggaccctagctgcaatccatttatcatagaagggtaaggattcccaataatagcttctactaattccatatcctgtggttccagttgtacaaaaaataaaaccccgatataactgcatgcatacatgcacacacacacagacacatacacacagatctggaaaatatataaaaatgcattaataatgtttaatatatgcttctgtatttttaaaagattttaaatatgtttgttttcttgtattgcatatgtatcttgttattcagcaaaaacatctggaagataataaaatgtgattttggatgaggtttcaccttttgtgctttttatatttcttctgtgttttccatgttttctacaaagcatatgcactcttttataatcagtcaaatacgtgtgtgtgtgtgtgtgtgtgtgtcaactacactttaaaaatgatatggagttaggccactggagtacttctccatctggtttttctttactatgacaccaggaagaaacagctgaaaagttaagttgataacaaattctaaaaaaaatgtttttactccatctacaaactttgttttgaagtgtgcagctgtcactggttgcctgcttggtttcctttcagacgccctgctggcattgaagaggagtctgttttatttgtctggtcagaaggagcccttgaatttatggatgaaggagacaccctgaggcctttcacactctacgaatatcgggtcagagcctgtaactccaagggttcagtggagagtctgtggtcattaacacaaactctggaagctccacctcaagattttccagctccttgggctcaagccacgagtgctcattcagttctgttgaattggacaaagccagaatctcccaatggcattatctcccattaccgtgtggtctaccaggagagacccgacgatcctacatttaacagccctaccgtgcatgctttcacagtgaaggtaagaccctttagaaaagtaacagacatgcagattatctggtgaatacgttgaaattaattttcttgtccaacttctcatttttcttcacttagggcttaaatatatgaaaatctttcacttgtgaaaagttgcaatgtagtcacggggataagatactgaactgagtatgaggagtattggagaccagtttgtagaccacgactaattttgattacctcaaaaccaataaataaattttatttattcataaaattgcctgatttccattttccatatttactaagtgggaatattttttttttgagacaggctctcattctgtcacccaaactggagtggagtggcgtggtctcagctcaccacagcttctgcctcctaggtttaagcaattctcctgcctcagcctcctgagtagctgggattacaggtgcccaccactgcccaactaatttttgtatttttaatagagaggggttttcaccatgttggccaggctagtctcgaactcctgacctcaagtgatctgcctgcctcagcctcccaaagttctgggattacaggcgtaagccactgcgcctggcctaaatggaaataatttagtcttgatttccattttccatgtctactaaatgggaataatgtaatgctttcctccatacctcatagagatgaggttcagatgaaattagacagaatatttaattttctacttccccaacaagctagtataatatatagctatatatatatgtatatgtatatatgtatgtgtatacatgtttgtgtatatatgtatttgtatatatgtgtgtatgtatgtgtgtgtatatatgtatttatgtatatatttaaatatacacacacacacatacacaaagttgcatacactatggcttactggtgatttttttcagggatggcttcctctggcccatagaacgacttaattcagttcacctgagcacttagtagctcctgagtgctttctttatgtccagcataacctcatggtctatggaatatacagaaacaggatggtccttgtcacagggagtgttccgttttataatattgcagagatgagaattgcacataaggggaaaagaatgagaagcagttgagtacagcctataatgtccactacactgagacttagatcccgaactccactatctactagctttaaaccacagtacaagagagagtaacatcatataccaagtgttaggcaagaaatgctctgggagatcaactctcaaactgaagatgcttcatggataagattaaattttgtggtcttgggagtgaaatacaaatatgtgccaagaccttattaaatatggaaaaccctcaataagaacaaataaacagacaaactaaagcatttataaaaaaaccaaaaaactatgtttctatgctttaaatcctggaaggccaatttacatgaaggttatcttatggaggataacatttatcaaaatatttaaattacagtgagcaaatatattttcattaaactccagaagagcccttttaaattaatagtttaaagtacaatgttttcccactgtcctcatgtttaattttctcatatgactaaaaaataagcaatatgtaaatgaaaggataattgttttatcttcatttttatctgtttcagaattagtactatatttttattagatagtaaattatgtactagagtcttttatattatgtcttctagttcctatatgataagcattagaagcagtgttcttaagtgtaaaagatactttttagtggatatgtgatccaggaggaagttcgttacttcccaccatatccttcaaactcatgttctaaactttcacccttaaagtaaaacgtttatgagtatactgaaacacccttgttaatagctttctgaatgaggcaccttaatttaaatatgtttttattgaaggcatcaggattataatgattaaacctctgatcttttaaaatacaactttcaggggtaggagcctaataatcatttagtctcacgaaacagttctattggaattcccttgtggaataaccctgtaagtcatcccttcataaccagcttcattttaaaacacaagatttaaagtatatgatgaatccatgaactctgttctttatttaatcttctaggctctatttttatcacactaaaaagcttctgaaaagaggcaagtgtatggccccaagctttaagcggcacagggctctttgcacatgggccctccctgatgtggctttcattttgacagtccagtactggtgtgcttttctatttttccaaagattttttttcttgcaatgtcgaatagattagccagaataattttaaaaacaatacttctgtgtcctatttttgaatgtgtatgtgtgtattcaaagtggcctcccaaaacctaaatctttggctcttagaatttcaagagaaggcttcattagatacaccaagaaaggtcccacctgatcttttcaagcaaacaaggacatcttccacaaagcaatctaggcaagtgttcagaccttctggccactggaccacgttttcagggcatcagggcaactatgactctttatgatctgacacctttgaaggaagtcatcaggaaaatgaactagtgtttttgtgtttcacttattcccacagtccctgtgtaggagattgtgttcaatatttttgtttaaaagatatctaggccagacgcagtggctcatgcctgtgatcccagcactttgggaagctgaggcgggcagatcacaaggtcaggagttccagaccagcctggccaacatggtgaaaccttgtctgtactaaaaacactatttttagtatttttactatttgagaggctgaggcaggagaattgcttgaacccaggaggccacggttgcagtgagccaagatcatgccaccacactccaacctgggcaacagagcaagactccgtctcaaaaaaaagtaaaggaagttctattacttatccagggttctatactcctcaccgtcacagaagaatgtttcttttatctcagacaaatcctgcctcctataatttaagtctatctccctttgttcagagcagcatgacttctccataatagcacaaaggggcttcagggtccaacaaattattgacaattcaatctgatttggcaaataaccattgagtactatattcaatatgtcaatattgaataccaaacttaactatgttgttgaagtctactgtgagacttggcccttgagcagagcagagactgtgaggaagaatgagtgattcgttctgaggcacaggctattactgttgggcattttgggtttttaagcttcttgcagctgcgtttctgctgcccatgtttagaagaccccatttcatttttatttttgtataaacttaatgggtccaagtgaagttttgttacctggatatattgtgaagcagtgaaatctgggcttttagtgtaaccgtcgcacaaataatgtacatcgtacccatcaggtcatttctcatccctcaccctgctccctccctccctcccacccttccgagtctccagtgtctattattccacaccctatgtccacatgtatatattatgtagtcctacttataagtgagaacgtgcggtatttgactgtctgtgtctgagttacttcatgaggataatggcctctagttccatccatgttgctgcaaaagacatgatttcattcttttttatggctgagtagtattctacagtgtgtgtgtttgtgtgtgtgtgtgtgtgtgtgtgtgtgtttcacattctatatatatccatatatataattacattctatggtgtgtaaaattattcctatttagtaaatatggaaagtggaaatggaaatcaggagatatatagatatagatatagatgatatagatatagatatagatatagatatcacattctgtttatgcaatcatccattgatgaacacttaggttgattcaatatctttgctattgtgaatagtgccgtaatacacatacgaatgcaggtatcttttttaatataatgatttattttcctttgggtagatgcccagtagtgagactgctggattgaacggtaattctacttttagttctttgagaaatctctatattgttgtatattgagaaatctctataggggttgtagaagactccattttaaatcgcatcccaagtacttccctagatctacttactgtttatctaatttctgcaccaggtaaacaactttactgtcttctttcctttctgtgcctgctgtaggaaatttttcaagtttttgtttattggccactctggctaaaattcttcagggcaaaggaactacagaaccttctccattaatgaggcacagagtccatccccacaactgtaggattgcagttcagtccacaaactcgcaagaggtactgctaatgcattagtcccttgtttattaagatctcatctctgcccaaggggccatcaataaattgcccatgttgtggtgccatcactagcttgccccaaggtccccccagagttgtttatagacaggtggatgttgctgagagagccacataaaacaggtgcaatggaggcatgaattctgcttgtggtggcagtggatggagaactggcagtgggggccctccgtgggggtgagaagcgtatgtgttggcaggaacagcagcagcggcagcagcagcagaggcagcaggagcagagaaatggaaagagtgtgggttttaatgcatcactagctgctctcccaacctcatgaaaagtttcacctccctactcatctctatgtaggtctttctaaggaagaaagagggagatcaagattcttggggtctctttagaccaataccttccattattgaaaacagctttaattagaaggccttaaactcccttcccaattagctctgtgatgaattgtgcggtgtcaggaaagaaactgtatttagccttgcttggcatgcaggagttccatggtggtatttacagggaacactcctggcaaggttggcgatattgctaccaccatttgggtttgtttgctttttctcactggcatctgccattgtgctggcagaaataaatctgataatttgggattttaaagaaaaaggtggtttacctattatctgtgccctaactatatccttgcttgttccacggggttataaaacgtcaagcccagatcatgcatttgcccagtatcctaaaagataaatggtacttcactctgtgtagaatcaagcataaggtgctgagaaataagcaaattatatgggtcactaaaaattggcttccaatctgggaataaaatccagaattactaactctagtttctagattctagttgccaggcttcctttcccaatgtcaaggaggaggtagtcaaaatttcctcaagggtttgtttcctatatctttaccattaagtagatatgtggcaaaaataataacaataataataaaatagatatttcacaattgccatgttatgaagagtgtgtgagtaaattgataaatttatttttaatcccattttcattttggcttagataacataaaatattactgctctttacatatgatcttaaattagtttcaactctttttaatttgatgattcttagccttttctccccagacacatttattagacaacagaaatactctgggagatgtagctttctaaaaggactcctttggtgactatctttctaatgtgaagaaaaattcagtaataaaaataattatcatatttcctgggtcggttctataaactgagattttcacattttataataagaaataactgtgtcattcttctatataaaagatagaaaacatgggtgagtaaatatcacacaaaacaatgaatatttgtcggcctaaccctttttttttttttttttaaagagacagggtcttgctctgtcacacaggctgcagtgcagtggcaccatcatagctcactgcagccttgatgtcctgcactgaagtgatcctccctcctcagcctcccaagtagctgggactataggtgcatgccaccatgcccagctaattttttaaattttttgtagagattgtgtctcactaaattgccccagctggtctcaaattcccggcctcaagagatcctcccgctgcggcgtcccaaagtgttggaattacaggcttgagccactgaccatggcaaaactttttagttgtgatgatattttagctttaatatcaacttttcatttacttgccttacataatctttaacccttttgtctaatttgggctagacaaattagactttcagacaaatatgtatttgtctgaaagtcataaatacatataaagaatctaccttttgctcaacattattggggatgaaaaccatgtaagtcttttgaaatttatgtaattacatctttgaaagagccatatttttctccaaccactttatcccagcaagctccatcaggattcccttgctcacccatcagtaacatctaaggcaggtcccatgattttccagtcacttttcagtggcaaggatcaacgcaactggtgattaagactcattccaagtgttttttaaaaacttcagtctagactgggggcgatggctcatgcctgtaatctcagcactttgggaggccgaggtgggtggattacctgaggtcaggcgttcgagaccagcctggccaacgtggtgaaatcctgtctctagtaaaaatacaaaaattagccaagcatggtggctggtgcctgtaattccagccactctggaggctgaggcaggggaatttcttggacccgggaggtggaggctgcagagagccgagattgcaccattgcattccagcctgggtgacagggcaagaacctgtctcaaaaaacaacaacaacaacaacaaaaactccagtctaaattaaaacctgatatgtgcttaaggatctgcagtggggaaagagggcatggtcattttcctctttcttcagttccctcttctcttatttatttccccaggatcatggcatgaaaagaaagaattagacaaaaaggaacagagctttactcaataatattgctctaattaatcttctattaattttgagggggcagatgcctcatgggattttctctgtgggttatataggggtccccataggaaattccatgcctcatagtcctctgatgcaggcaatacactctctggctaatttcttactatttgttattgtccaagaggtccaccctacaacctttttttgcctctgggggcccttctcccaagcaggcagccaatatcaagtcctatcacgttgacaaaactcattcctttcttggcacccactaggattgcagaaaactttggtttcaccaaataatgaaggtacagcttgtccagtactatattctctgcttgacctatcatgctggatgaaacctagccagtctcctaactttggaattcattgactaagacacaggtattagcttctgtgctagcctattatcccaaaactatgggatcacttaaggatttcagaagacccttttgactctagtcattgcatcaaaattgtcctatgaatttcatcagtgcagtaggaagcctcttgccaagaccagactgttcatctcacttttctggcaacactcccaatttcttcaagagcttctcttggatattccttgcatgccttgaaaggggagtgtggagaaatcccattccctccctgaagtgggaaagatataaccaaagcctctttcttctccactgaatccccttctttaattttttttatgaacttggatcttctcatataggttgtctacatagatcttcataggaagatggatcttgaagtctgttttttccataagtcatgcagtgatatgtctagctgttccagtagagttacttaccacctatttttctaaatcatactcattattctccaatacagttctgtttcacatcctattatataactaaatggccctatcatctttctagttgcacaagccagatcatttttgagtcctctctcttccttacttccatatcaattcttcactaagtgctattgattctatttccaaaccatatcttaaatccttccacttgaagacaacattaggatcttcacacatgttaatccctcctcctggaatgatggctcattctcctataattcatctgtcctcattcttactcatcaagtctgaactaaaatgttgcttatctcatagggctgctgcaatgactaataaattaatgtatatgcaaagtactgtaaagggcaatataaatagactataaacctttagcagtccttctttttgaaaaaacagagactggaataaattagcaaatgtagataaggttctggtttgtctaggcaactgtactaatttggtcatgagtgaaaaaccttatgttttatacattttaagtgttcctcaccttgcaataaaattctgagcttgcaaatttacatgtttcctgataccacattgttaatttccctgtaattttccaaatactggattaggttctatttcctttctaaactgcctgaagcaagaacatgctttttttttttttttttttttgtctcctgaggtttattacggtcttatccctggcccccctgccccaacaacatcacatacctgccagtctaagagccctcctcaggagatttccaccctatatgtagttctctttacctgacatgacactcttaggaccctaccctttcccttagatctgggattatatcagcagaacatgatgaggtattttagtcacacacacacacagacacacactctcacacttctcaaatcatacaaatggattctgccaaattggcatctacctacttcccctatgccaaatagtagtttatcagtacatgagggacagttagttggtggggagactgtttgacctgtgagtcaagtatgttgctattttctggcctttaaccaacttacaaggaaaccctctttagacacctaagactcccgtggagccttgtcaaaaatgtctgtgaaagtaaaatgaactagtccacatactaacaggcccaggccataaattcagaatatatgccatttagcagagacagcaagctgtaaatggcagtgaagggcagaagttaattgaactactctgctcttgtcacagatggaaagtagccactacctgagacaagatggctgccccgaagtaccctattacagccaagagatcatatccttagctctgcaagggcttatgggtgagggggaaatcatacacagatgaccaatttttttatggttcacagccgataaaagtgaaattcagcagctgttcaggacaagtgaccactgtaacagctgtaatataacctactaaatagagagggaattgcattagagcaagaggttagctgtgatcatcggcaggtgagtgctttattgaagttgaaagaccattaacattgatagagtaattatttcaacttgaaagtaattaccttgatgggtgataacttctctagtgttcccagatttgattgggccaaacaattgtgagctcctgaagcctagaaaaatattacaacaatactgtgatttttaaattactgaaaccactgttggaatattctaattatgccgaacagtgaaaagattttgccttacacaagctagtgacctctcatgtagagagagacatttgctttttaatccaaatgcaatgacccacacccaccacctgtgaatacatatgtgatgggtttgcaaatgaatctttttatctcaatataatttttaaggtgaaacatcttgttagtgctgtgcctgggtaatagtaagctagaactgctgacatttttgatcatatctatggacttgaagtctccagaatggcaactatcttctatctttgtcacagagggtttaaatttgtataaattaaatattttgataatgactacacataaattagaatttctggatgccacgtactttggatcccaaatttcagatattatctagttacataatcagttgtttaaataactttctcgcctgatgttatgcaactccactacaaacactccattgtcagggtattttccgtttacctacactggacatcagcaaacaaaattaaagttgaaaacctgggctattgcttctctgtagtctcatgaatatatgaaaattgcaagttatttgcaattgagggccaagacacatcaaatctaattcagtgatcaagaccaagaaatacagggctcttccattaatcagtttttcaccatatttctcttttgagaatctacttggtccagaagctataacagatacaaacaaacgagaaatagtcttttctctctgaaactcgtcgtgtatttggagaaacaataagaaaagagacaaaatacaatgtaataagcaatcattttgtcatgcatggtattgattgtacttataaatagttacaagaacctaggaagactctagcccatactcctgaatccaaacccagcactcattctatggaaccacaaaccattgacagaaaaaacacaggcatcatgattcttagtcatgttgtcagaaaagatgaatgtgacatcaccttaaagttcctggatgattccgtagacctttctatcatcttggcagggtttgatcagatgatcagccaatgaatgactatctttttggcggcacttcccaggagttttttctaatcaaaatctcagactctcctagggacaaaacaggtttctacttgttgtctaagagccaataaggaatgttttaccaagcagttaatgggtttctttcatctctccatctcggctctgaattcccctccatagacaaagtctttgggtctctgtttcagaaattaccgtagggtagaaatctctgccaagccagaagacatttgcccactggaaagtaatgtaactggcttgaatttggtaaaagagtgaaggtttgagacaaaaacataccacttgggaaagtgataaaaatttatgaattgaattgtaaatcttgccattaagccaaccaaagagtaacaaaatctgaccaatctgacagcacatcagagttcttagcacagcaggctcaccatgtgtcatatacagccaggctaaagattgtattaaggacccccttaggtactctgaatttaaaataagtgtaataactcatttttaaacattttatatgatacttgaattattaaatattcacattacaaaatcagagaattttaatccattcaaaagggtgggttgtctaacactgaaagataatggtcatgtctagatagtaaaattacagtatatttttaacggatgtacatgttactttttgacaagacacaagtagtgaattttatcgtacaaattcctattgggtgattatgatacagagttttatttttgctaaagcaattactaatgtcatggctggatacctgtgcccattagtggctggttctgtgtttttttaggatggttattgatctcttgctgagctgagattcaggttttatgccagatagcttgattaatgggttggtttctataagtggactgaatggggatagaaagcaggggcagcctgctctgccaaccccaaatccgtcaagacgcatagctcattatgaaacagttatcaaggatacatgaaaaattaattgggctcagtttgattctgaaaagaatcggctttctacttggcgggcccccccgccccccttccactctttccagatgttctgcaccagcccctagagaaacagcaaagggagacgtattaatacattgtattgattagatcaagacccctgacagttatttgtagagataccatctggctgctgttcgaattccttcaccaaaaacaggacgtgacatgttattaatctcaactctctaagtatagacagttgccttttctgctaaaccgcattttaccattccgtaggagatggaggaagacctgaagggtgcagaaattaaggttattacacaaattgagccatatggtccaaatatttcagcaagaaaattgccaggcaataaaaattgctcctgccttcctaatggtgtaaattacagtttaaccatggctctaatgatgtccttctgccgcgcttaactactgttacatgaaggacattgttttaaaaatataaaaaacaagtaaatgccagcagcgtgttttacaatctgttagtgtgtcattaagaacactgtcagaattacataaacataatggcaggcaacccagcatacaaaggaactcgtatggaaatagaaagtgtcttgaaaactctcttcattatctctgaaatgtcaagagcactgtcccctctggaagttttctagggagaaaagacctgtccatctagtgctttattctaattctcatgtgtgtcccaacagcagtgttttctaaatcaagtgtcacaacccatagtgagactaagtacacatctggtaccacaaccctgtccatatacaaaaaatgaagcagacaaggtgaggagacagctaatgaattctaaacaaaatgatagacgttgaccttttgaagtatttttgtttttggggaaaacagttaagactccactatcttccttgatgatgacatcaacaattaaaagtataatttctatcctcagcaaactaacctggcaacagaaaaccaaataccacatgttctcacttgtaagtgggagctgaacaatgagaacacatggacacagggaggggaacaacccacactggggcctattaggggggtgaggggaggaagagcatcaggataagtagctaatgcatgtggggcttaatacctaggtgatgggttaataggtgcagcaaaccaccatggcacacgtttacctatgtaacaaacctgcacatcctgcacgtgtatcccggaactttaaattaaattttaaaagtataatttctgtcatccctatttggggcatgatattaagaggaagcttacttaagataatcaaaaatctttgggaattacaataaagaccattaatatttgagtaagacttgaacccttcaaatatttttagacctattacaccaaaaacacctcggcacttaaaaattccatataggtcatattgatgttttattctctaaaactgcacaatcctccaagctttttggtcttctaagatgttataaacacagtttgttaaaggaaaagtccagataaacgtttgtagaaaaatttgaagggaaaactacttttaattcccagaggagagttgccttatctttaagccctttttccttctccatttccccaaagggagaaagaccaggatataaattgccctttaaactaaaaaagaaaaaagagagggaaaaaacctaggaaaccaaaaaattattctttttgcatgcatgcattaatattaatgagaacccattaagttattatttcctcatggcacaaatggcaaggctagcaatctattgactagagcatcttctgcctggaaagctcttacccaggtgtccccatggttggctcccacactttcttctggtcttaagtgaaaagttactaccactaaagccttacctggcctactcagctacaatttcactccactctccctcacacacactttctattcctcttctgtctttatttttctctttaatatttagcttttatttctggtttcttgctaacctgtaatcatatttcagaaattgtttttcaaatgctttgttatgcttcttatttcacctaaaaggaaatctgtatgttcacagctaaatcaaactgagaaagcatcatttatatgttccaatttcaatttataagctgacaacttccacataaaacatattatgggcactttacacatgccatcttatttcacctcaataaccaatctgtggagtattattacctaaatttattaatgaggaaatggaaactcagagaggttaagtagcatacccaaggtcacacagctagctgcagagtttggatttgattgcagctctctcagcttctaaagccttttctttctgttatccagtattgcttcttgagtttcagcctagtggaacaagatgttatttatgaaaagctaaacatcaatgaaagccacaaattatagttcaataggacaaagagatgacacagagcttgatatgattcattgcctagtataaatatagaaaacaattgataaaagtttcaaagaattaaaagatcacttggactggaaaagttcagagaaggcttttgggagaggtctgtgctttgaacaatgggtgaaattcaaatagaagaaaagtagaacagatattaccttattcaggcaaagaaacagaagcctggttttgaaacatctgatggcaagtctctgcttcaggaggtcacatggggaatatttttccaatatgcccccattaattgggctgatattaaaacaactgatttaaaaaaaaaatcaaaatactcccaagagatgcctagcaaagctattgagtgaggtggttagcagcatgggtctggggtcaggaaacatagattagagactggctttggcttttttactcattgtatgccttcaggaggttatgcctaatagtgcctcccgcagagaggcagcacctcttagagtcgcaggaactgagacggcactcagtaaatagtggtgagtaagattcaaaataggttttcagagaagaaatcagcacatgaagatatcatggtgtcatagtgtgttgacagggtcctgtctggagatactagtccagaatttcaaaaaaaggaaaagttttcttctggccgggcgctgtggctcatgcctgtaatcccagcactttgggaagccgaggtgggcagatcacctgaggtcgggagtttgagatcagcctggccaacatggcaaaaccccatctctactaaaaatacacaaattagccgggcatggtggtgggcacctgtaatcccagcaacttgggaggctgaggcagggagaattgcttgaacccaggaggtggaggttgcagtgagccgagatctgccactgcactccagcctgggtgacagagcaagactccaaaaaaaaataaaagaaagaacaaaagaaaagaaagacaggaaggaaggaaggaaaatttattatattttcttgtttcccctgcattccctaatacccctttcccaaaagtatggatttcttcactaaatatgttagtagcagaatggtcttgtggcagttgacccaagactccaggtagagcagtggggaaagaaaagacaaggccagccaagaggccagccaagaggacaagctcctccaaaggttgacttgagatattaaactcattgaaaaagttactcaacatccacagtgttctggtggtacctcacttagtcctggacaatgaatcacagcccaagcttcatcattgaattggtgacactgccgagggccaactcaccagccttcaaaaacgacagtgctgctgacagcaaaggcgatgaggacacacatgtgcatccacccttgagatgctaaaagaggcaggaaagaacttgagggaaagaacaaatcactcttctgagattgtcctataaactttataccaggacctatgctatcatcctccttacctaatcatgtttaatatctgatttataagaatctaaatgtgtacctaaaagtagctttctaaatattactgggccacattaaactgtgaccaattttcttccttcctggcctaccacattttagaaatatgatagcatatttgggttgggagtcgctaaaggcctcaagagagtccatctctttgtcctttctgactaggaagacctggtcatcacgccacaagccttggtgtctcgtttttaacagagcaataattatttattagtggaatatatgcttattatatccagaaattaaagttgttaggggacatttgtgtatccaggtccctgtggctgggtgatcgcatctgttagaaataaatcactttaagaaaattatattagccccacagacagtcaagaatggagcaaagggagggaagtgtgaatagggtgaggaagcttgattttaaatcttgtgaaatagagtgtggtcaatatgttgtcagcacattacagtgtgcagacatcaactccatttttcccctctttgaacctcaggtggccaattaacagtatatgctatttattcattacaaaacaggcaggacaaattgaatggttagaatgactaataagaattcttagcaaggagtaaaataaaaaatgatacataaggagagaccccccagaaaaactttagggatttccagaaaaaaaagtcttgaggagttttcctgttaaatgtatctagaatttctactgacatgaggaaattaaaatggaaagattctctttgaatacattttcttcctaaaatatgttctcttcaattccctcatttgtatttccttagagtttcattccttcctaaagcagaaagacagttttaaattacttctagcaattataagtatcattagggtgttttgatgctgcatttttacaacaagcactgtgcttgccttccttatttgtctctcagttcaactccaagtcgcaacacaggaaatgaaaaccttgtaaattgacttgatcttatgaatactcacttttgcaaatatgaaagaacttaagaagggattataaaatactccttatctatataattaaaattcagttgaaatatatgaattcaatattttaattcatgcatttcattttgcgggcattcaaagattatatgcttctatatgtctgccattgatttctgtaaataacattatctctcttattgcaaaacgtacatcagaagaagttggaagaaagcgagggcttgagggatgttaaactgaagcagcagtgacttactatgcagtgttagtagattgcttgccttgaggatctagaagccgatagaagaaatggagccagcaaataagaaatttcttatttcttattccagaaataagaaattctgaacttttaccttcaaagatccaaaaagaacatgctaatgttcttttttttctaacttttgagtaatttagtcattctcgttcagaaaattaagggtctacatctggcagcaactgaaataaatggctcaattgagtacacacttgaatgtcaaatatatcactttaaaagtcaatatttgtttcagctgtaaatgtttctgaacggaaatgatgcttttagtgtctgtagtctaaggagtagttttatttttgaaccctcaaattgagtgctccacctagagccgtaggaccctttcctttccatgaggagagcgccctctactgggtatgtttacttaccacgcatgactgttaagaccctgagctaaacgtatgagcagttgagatgtacataagaaagagtttttggaaaatctttgcccctgcttgtactagaatgattgcaagtgtggaagtagccatagttcactgtagttttctttttactgctgtattattgcaccctgttgggggatacatctgagcatttcatgtgtcctacttttaaaatgcccagatggtggctacgtgctttggtttgaattgggcagccctcatctttcatgctctgtagtctgcctcgttatcagagagacatgagacaaggaaaattcttccatttttcagctcctcttcatctgtttctagtcacccacagtgaatgatgcacttgcacaattgttaaaatgacagtcactgtgataactgaacatcacttccctgggatggggagttccctatgtacccatagcttcttgattccttcccaatacagcacctttttcagtgtaactgatcacttgcaatcttgtaagtaacacagcagtgagaggcagtgtaaatattttataccttgccccaatcacttgtatgtgcatcggtcttcttcactctagcctttaagcttaacagagattttaaatcaaatcattcaaccctagaaatagtcaaaagaattaataaaataaatgaaacagtgtaactggttaaaatagccccagtgcacaatacaggtttagtatgattttgtgacatacacattttatagggcttttgtctccaactacattcttcaaagagccatctgggcaatgaccataggtatcatttttaccaataatagtcagcacttcccactgggaaattagtcaagggaatgagtttttttttttttttttttttttttacaaattatcttcaagcatctatcttccaaaaagtattactggactttgtccattacaaggcaacaacctaagtgagttacttgtgctcttattttagaactttattcatcagatcattgtgatcaaactcaatttcattttcaaagaggaaaaagattttgctctgtttttcttcttaataataggtttgctgaaggaagaacattaatacaggtcagcgatctccaaactttttagaatattcacttgtagaaataataatttggggagcacacatctgcataatatgtatatttacttatttgtaaattataaaatatgtactagttaaatagtatcatttacactatagaaatagacatttttaaaggagtggaaatagataaaattatcaagaaaatattttattatgagcaactactatcaataatacctcaaggcacaatacacactgaaagattaatcattaatgatgctgaatgtcaatctctttcctgagtgttcttgatcatttcaaaattttgttgacacttctgatcaaatacaattggaccattcatgtttatacctcatgctgtggttgataaggagcttgaaggaaggagaatcagactggccatttatttgttcttcatttatgtttgtattgttagtgttatatttgaatcataaatttgaattctaggaattttgaaagccattcatgtttccaaagttagtatacttaaaaccagataatataatccataaacccccttagcatagaaccataaactacaatatgtcacttgacacaaggggtccagaaccccggggacgcagaccagtactggtctgtggcctgttgggaaccaagccacacagcaggaggtaagtggagggtgagcctcaccacctgagctccacctcttgctgtgctccacctgaggagtggagcacagatctgctccacagatcagctgtggcaattgcttctcacatagcaaaccctattatgaactgcgcacgcaagggatctaagttgtgtgctccttatgagaatctaactaatacctgatgatctgaggtggaacagtttcatcctaaaaccatccccacctcccccttccatggaaaaattgtcttccatgaaacggatccctggtgcccaaaaggttggggatcactgctttgcactaaaagcaaacaaatagatgaatattgttagctcctcgctgtaaaactcccattcttccttttccaaggacagatacagaacttaattgattcattcattcactcatccagtcagtatgtgtatgcatctaatatatgccaactgggtatatgacagtgaataaaccagacaaaaatgcttccctcttgaagctcttactctagtggggagataaagacaataaacaagataaggaaataaaatatatacataccatacataagctaagggcaatggaggaaaataaagcagattccagagtctccattataaaaaatacaacttttgcaaattggtctttagttcttattgagtttaaaaggatgtttcccttccacatccttcttcccactgtcttctgggatttttgcttcagatatgatggtcaaattgcttattataaattcccttctaagattctatgagttttaaatttgttttaattgttcacatgttgcattgaatgatgcaattgtactcttctagcacacagagctagtaaatttcctatatattgatatttaaagcctgtccttttatggagtattttgtgaccacctaaacccatgatgatttcttgtgtatacaccttcagtgcttggttcccatgtatttctctagtggtttcagaaaggtgagttttacattcctaatggattacagttcctaaaatccagtatgttcatactttctacttttattcctttccatttagtgcctagaaccatgccagaaaaagacataatttgactgtggatttaaccctcagatcacaaaccaatctcagagctttatttttttgctgagagttttaaataaactataaagtcaaatttaaacaattatcctttggaatcaacagaaccccacatttccttagctttccttagctgttcctattcccaaggatcacattcagagcactcttcttgagtgacagtgatgtgccaggtacttcacagaggtcatctgttttaattgtcacaaaagcccaagagaaagatactaactgttagaaatctagctcagaaaaagtagatgatttacctaaggtacatctagtgtgagtgacaatcagaacttaaactcaattcttctaagttgactgctgttttgattaaagcgcctgggctctcagaagtggactcttcctgggtgttagtcacaagggcttctcagaatttttctcctacatatgagacagcagatcatttctgcctctctgctaagataagccaagcaaaataatagattgtagaacaattaataatgcattcaaaatgccaaactcagcacactttctatcctttgtgaaaaattttgttcccattttgtccaaatgtctaataaaaatgattgtggaaaaataaaaacaatctttgatctgcctaaatgaaaataagaaccacaacttctagctctcagaacaaatcaaagttgtttttatttttaattaagtatgctaagcttaagtacattttctcttaaggtgtaattactaaaccatgatgatttctttttgtttattcatttaaaacacaaataaaagcagataatcaatagatcataatctaaaactagaggatttacaagttaataagcttgagtcaatagatattccataacaaagctttcaatgctgaacctgacataatttgctttgcactaagctggttgacttaatgctttaatttaattccaatattaactgaaaaatccaaagaaaaggggaaaatttaaatcctattatactgaaatatgttcaaagcaacaactcaatatcctgccacaactgcttaagtgtgccaccaaatgtctgcttaatcacctggtttctgattggtgataaccagttaacccgtttggagcctggtacaagtgaattgtggaagtttctcagtggtccattcatgcaatagcttttatcttagcctcaacagtcatcatattttcatctcataatgtctacttttcctgacttatggccaaattattggagttgtttttatttgaaaagcaatttctccttgtctcttgagattaccatccagcctgacctcccaaaaagcagaacagtaggcaggcctaggtcaaagaacagaagaaagcctttcttagttccctgaaaggaagatgtaagaagctatctgtatgaagaaatagcattagatggcatccatcatgcaaagtctggtagtactagtagaggtagtgagagggatgtgaggcaatatccagcataccttcaaggttatgagcacagactcaaaagacaggatccccccaggcaaatcctggttcttccccttacaattatatgaccatggacaatgtgcttcgactctcttttcatccatttccttatctgaaaaatgagggtcataatagtgtctatctcataaggttgttttaaggcttacacaatttaatatacataaagtacttgaaaagcactcattgttatcatcctttgagatactcttgaggcataaggaacttatgctaagaataattttgagaacagcagcatcagtcactgaatatagtagtcagatgtgtctttcagaagagttatgtgtgcacggccaaagtcctaaatattccatttgttaccatccttaaaatatcatttgtgaatttgtaactggtttttgctttgtgtcattgctggtcgactgcagtcagggtggcagtgttttggctgccccctaccatctttagttttctggtcccattagtgttgtgaccaagaacaagttagtgccctttgctcaagtaaatgggctagaagttaagcactgaccttttaccataggggacccttttctattctgaaagagaacttagaaaacagaacagaaatctcattgatttttacaatgcacattttttcatatttctccgtctctgaaattgcatgcatctaacaatcttataatcactgtagatggcagttgttacatacttgtcatttcctgtgcctgcacaaactctcgtcacttcacttgagttctgtgcaccgttggtacgacacacacattgagtttaattgccacttaaaatggcttcaaaaaatcatactatgatttggcattaaaataaaaagtatacacaaaaggcacagaaacagtcacttcatataaaacttaaaaagaaaaaacaaactatgcccatgcaagtctaaagaagtctttcaataagtataaaatacacatctaagtgataaaggaatcactgtgttcttgttgaattagcagcatatttttctctttcttagggatacataaaatagtttttaaaaaaataacagtgtgtttaaatagatgaaatcctggaccccaaaaataggtgtgttttataataaatatttttaaaacagctagcatattgccaataagataatgtatttaaataaaagataatttattcattccgcagacatctatagagcacccatatggtgccaaacatattttgtatccctagtccctgtcctctaagagttcaaggtctagtggggagaaaaggcaggtaaatagatcaatctaatataaaaatgccataaacagcagaaagaacagagaagagagacaagtaactcagtctggggagtcaagacactcttccaaatggagatgacattaaatttgtattttcaaggatggaaatacatcctttccaggcatagaagggcattctaagaaaagaggaaatcatgaacaaaagcgcagcctcattgaagagtgtgttgtaactgggtctgagtcatgagtctagggacagggtgtgaatgaaagaggcagaccagggagaggctaaggatgtgcccaaagagacaggctgcaggagattttgctggtaagggctggcaatcaaaaccaccctgcttcctaaccaggtctaggctctggcatcactctgacttttaaattaggaaagttagagcttgattcttgcacttgactctgtcaatgcattaggatctaggagagatggtaagtgatgttggaaagcagtccaaagttcataagcagttagctatttccatccaaggatgccatgatttcctctcctgaaactaagtgaacagccatgggtaaaaatgaactgaaggcagaacatgggcctctcatgtaaaagcagaagtaggggattcccaggcaagatggccaaatagaaacagctccagtctgcagctcccagtgagaccaacacagaaggtgggtgatttctgcatttccaactgagatacccggttcatcccactgggactggttggacagtgggtgcagcccatggaaggcgcagaagcagggtggggcgtcgcctcacccgggaagtgcaaggggtcggggaactccctcccctagccaaaggaagccttgagggactgtgccatgaacgactgtgctatctggcccagatactacacttttcctacagtcgtcacaacccacagaccaggagattccctcaggtgcctacaccaccagggccctgggtttcaagcacaaaaccaggcagctgtttgggcagacactgaggtagctgcaggagtttttttttccataccccagtggcacctggaaccccagcaagacagaactgtccactcccctgaaaagggggctgaagccagggagccgtgtggtcttgctcagtggatcccacccccatggagcccagcaagctaagacctactggcttgacattcttgctgccagtacagcagtctgaagtcaacctaggatgcttgaccttggttcggggagggatgtccaccattatggaggcttgagtaggtggttttcccctcacagtgtgaacaaagccaccaggaagtttggactgggcagatcccaccacagcaccgcaaagccgctgtagccagactgcctctctagatttctcctctctaggcagggcatctctgaaagaaaggcagcagccccagtcaggaacttagagaaaaactcccatctccctgggacagagcacctgagggaagggctggctgtgggtgcaacttcagcagacttaaacgttcctgcctgctggctctgaagagagcagcagatttcctagcacagcacttgagctccgctaagggacagactgcctcctcaagtgcgtccctgacccctgtgtcttctgaaagggagacccatcccagaaggagttcatagacatctcatacaggagagctccagctggcatccggcaggtgcccctctgggacaaagcttccagaggaaggagcaggcagcagtctttgatgttctgcagcctccactggtgatacccaggcaaacagggtctggagtggacctccagcaaactccagcagacctgcagaaaagcgccctgactgttaaaaggaaaactaacaaacagaaagcaatagcatcaacatcaacacaaaggaagacaatgaaacaaccccatccgaaggtcaccaatatcaaagataaaggtagataaatccatgaagatgagagtaaaccagcgcaaaaaggctgaaaattccaaaaactggaatgccttatctccaaaggatcacaactcctcgccagcaagggaacaaaactggacggagaatgacttcgacaaactgacagaaataggcttcagaagcaaggtaataacaaactcctccgagcaaaaggagcatgttctaacccaatgcaaggaagctaagaaccttgaaaaaaaaggttacaggaactgctaactagaataaccagtttagagaagaacataaatgatggagcagaaaaacacagcactagaactttgtgaagcatacacaagtatcaatagccaaatcaatcaagcagaagaaaggatatcagagattgaagatcaacttaatggaccagtgcaagaagattagagaaaaaagaatgaaaaggaacaaacaaaggctccaagaaatatggggctatgtgaaaagatcaaacctacatttaattggtgtacctgaaaatggcaaggagaatggaaccaagttggaaaacacacttcaggatattatcaaggagaacttccccaatctagcaagacaggccaacattcaaagtcaggaaatacagagaacactacaaagatactcctcaagaagagcaaccccaagacacgtaatcatcagattcaccaaagttgaaatgatgaaaaaaatgttaagggcagccagagacaaaggtcgggttacctacaaagggaagcccatcagactaacagtggatctgtctgcagaaaacctacaaaccagaagagagtgggggccaatattcaacattcttaacgcaaagaattttcaacccagaatttcatatccagccaaactaagcttcaaaagtgaaggagaaatgaaatattttacagataagcaaatgctgagagattttgtcacaccaccaggcctgcattacaagagcttctgaaggaagcactgagtatggaaaggaaaaacttctaccagccactgcagaaacataccaaaatgtaaagacgatcaacactatcaagaaactgtatcaactagtgggtaaaataaccagctagcatcataatgacagaatcaaattcacacataacaatattaaccttaaatgtaaatgggctaaatgccccaataaaagacacagactggcaaattggataaagagacaagacccatcagtgtgctgtattcaggagaccaacctcacgtgcaaagacacacataggctcaaaacgaagggatggaggaatatttaccaagcaaatggaaagcaaaaaaagcaggggttgcaatcctagtctttgataaaacagactttaaaccaacaaagatcaaaaaagacatagaagggaattacatagtggtaaagggatcaatggaacaagaagagctaactatcctaaatctatatgcacccaatacaggagcacccagattcataaagcaagttcttagagacctgcaaagagacttaaactcccacagaataatagtgagagactttaacaccccactgtcaatattagacagatcaacgagacagaaaattaacatggatattcaggacttgaactcagctctagcagatctaatagacatctaacagacctaatagacatctacagaattctccaccccaaatcaacagaatatactttcttctcagcaccacatcacacttattctaaaactgaccacataattggaagtaaaacactcctcagcaaatgcaaaagaatggaaatcataacagtctctcagaacacagtgcaatcaaattagaactcaggcttaagaaactcactcaaaaccacacaactacatggaaattgaacaacctgctcctgaatgactactgggtgtagaatgaaattaaagcaaaaatacatacgttcattgaaaccaatgagaacaaagatacaacataccagaatctctgggacacagctaaagcagtgtttagagggaaatttatagcaataagtgcccacaagagaaagcaggaaagatctaaaatcaacaccctaacatcacaattaaaagaactagagaagcaagagcaaacaagttcaaaagctaccagaagacaagaaataattaagacgagagcagaactgaagaagatagagacatgaaaaacccttcaaaaaatcgataaatccaggagctggatttttgaaaagattaacaaaataaatagactgctagctagactaataaagaagaaaagagagaagaatcaaatagacacagtgaataatgacaaagggaatatcgctactgatcccacagaaatacaaactaccatcagaggatactataaacacctttacataaataaactagaaaatctagaagaaatggataaattcctggacacatacaccctcccaagactaaaccaggaagaagttgaatctctgaatagaccaataacaagttctgaaattgaggcagtaattaatagactaccaaccaaaaaaagcccaggaccagaaggattcacagccgaattctaccagaggtacaaagaggagctggtacaatttcttctaaaactgttccaaacaatagaaaaagaagaactcctccctaactcattttataaggccagcatcatcctgataccaaaacctggcagagacacgacaaaaaaagaaaatttcacaccaatatccatgatgaacattgatacagatattctcaataaaatactggcaaatcaaatccagcaacacattataaagcttatccaccacgatcgggtcagcttcatccctgggatgcaaggctggttcaatatacctaagtcaataaacataatctatcacaaaaacagaaacaatgacaaaaaccacatgattatctcaatagatgcagaaaaggccttcaataaaattcagcaccccttcatgctaaaaccactcaataaattaggcattgatggaatgtatctcaaaataataagagctatttatgacaaacccacagccaatatcatactgaatgggcaaaagctggaagcattcccttggaaaaccagcacaggacaaggatgccctctctcaccatttctattcaacatggcattgaaacttctggccagggcaatcaggcaagataaagaaataaagcatattcaaataggaagagaggaagtcaaattatctctgtttgcagatgacatgattgtacatttagaaaaccccatcatcttagcccaaaaatgccttaagctgataagcaaattctcaggatacaaaatcaatgtgcaaaaatcacaagcattcctatacaccaataatagaaagagagccaaatcatgagtgaacttccattcacaattgctacaaagaaaacaaaatacctaggaatacaacttacaagggttgtgaaggacctccccaaggagaactacaaaccactgcacaaggaagttaagagaggacacaaacaaatggaaaaatattccatgctcatggataggaagaatcaatatcctgaaaatggccatactgcccaaagtaatttatagattcaatgctaccccatcaagctaccattgactttcttcatgaaattagtaaaaattactttaaatttcatatggaaccaaaaaagagcccatataaccaagacaatcttaagcaaaaagaacaaagctggaggcatcatgctacctaacttcaaactatactacaaggctacagtaaccaaaacagcatagcactggtaccaaaacagatatatagaccaatgaaacagaacagaggcctcagaagtaacaacatacatctacaaccatctgatctttgacaaacctgacaaaaacaagcaatggggaaaggattccctatttaataaacagtgttgggaaaactggctacctatatgcagaaaactgaaactggacccctttcttagaccttatacaaaaattaagatggattaaagatttaaacataagacctaaaaccataaaaaccctagaagaaaacctaggcaataccattcaggacataggcatgggcaaagaccttatgactaaaacaccaaaagcaatggcaacaaaagctaatattgacaaatgggatctgattaaactaaagagcttctgcacagcaaaagaaactatcatcagagtgaaaaggcaatctacagaatgggagaaaatttttgcaacctatccatctgacaaagggctaatatccagaatctacaaggaacttaaacaaatttacaagaaaaaaacaaataacctcatcaaaaagtgggcaaaggatatgaacagacacttttcaaaagaagacatttatgcagccaacaaacatatgaaaaaagcctcatatcactggtaattagagaaatgcaaatcaaaaccacaatgagataccatctcacaccacttggaatggtgataattaaaaagtcaagaaacaacagatgctggagaggatgtgaagaaattggaacacttttacactgttggtgggagtgtaaattagtttaaccattgtggaagacagtgtggtgattcctcaaggatctagacccagaaataccatttgacccagcaatcccattactgggtatatacccaaggcattataaatcattctagtataaagacacatgcacatatttattgtggcactattcacaatatccaagacttggaaccaacccaaatgcccatcaatgatagactggataaagaaaatatggtacatatacaccatggaatactatgcagccataaaaaagaatgagttcatgtcctctgcagggacatggatgaagctggaaaccatcattctcagcaaactaacacagaaacagaaaaccaaacaccacatgttctcactcataagtgggagttgaacaatgagaacatatgggcacagggaggggaacatcacacactggggcctgtcaggggctggggagaaagaggaggggtaacattaggagaaatacctaatgtagatgacgggctgatgggtgcagcaaaccagcatggcacatgtatacctatgtaacaaacctgcatgttctgcacatgtatcccagaacttaaagtgtaattaaaaaataaataaataaaagcctgggtgtggtggatcatgcctgtaatcccagcactttgggagtccgaagtgggcagatcacctgaggttgggagttcaagaccagcctgaccaacatggagaaacgccatctctactaaaaatacaaaattagctgggtgtaatggcacatgcctgtaatcccagatactcgggaggctgaggcaggagaattgcttgaacccgggaggcggagattgcagtgagccgagatcgtgccattgcactccagccaggtcaacaagaacgaaactccatctcaacaaaaaaaatataaataaaaaattttttaaaagcagaagtaggattacagaaagcagagaagcccaaaagatttgaatgttcactgacaaacacagcaataaagtatttgatattgcaggcttcatttgaagtaaagcttcaggaatacctggaaaccaagctacaggtggcactcagctccctaaccagcctttgccaagaggaggggtctttccagagacaaccatagagagtaatctttagccatgttatcgtctaatatcaaaaatagggggcaggccaggtgaggtgactcacacctgtaatcctaacactgtgggaggccgaggcaggcagatctcttgagcttaggagttcaagaccagcctgggcaacatggtaaaactacatctctacaaaaaatacaaaaaaaaaaattagctgggcctggtggcacatgcctgtagtcccagctacttgtgggactgaggtgggagaattgcttgagcccaggaggtcaaggctgcagtgaacagagatcatgccactgcaccccagcctgagtgtcaaagtaagaccctgtctcaaaaaacaaacaaacaaaaaaaaaagagggtgtaatggaagtgttttaatatgaccacggcatcctctcactgagatctgctaccatttattttattttgtttgtttagagacaggtctcactatgtcacccaggctggagtgcagtggctccatcatagctcactgtatccttgacctgggctcaagtgatcctcccaccttggcctcccaaaatgctggttagaggcgtgagccaccatgcccccatttgtaatttaagctgataaatgagagcaggggcacaagtctgtatccgctaactcttcagcaacagctgacccaaggccagcaaacccattgcatagccaacaaccaaccagatcctgtctttctgaagacacacagagacagtagtcagatggttatgactaataaggctgtaaggttgtttagactgacaattggtagccatgctgggcaaaagggaaagaaagaaaattaagagaaagggaaaagagagagaagtgccatgcagcccctgagtgacagagagagaaactcagttctgacagttttccagtttcaaaacccaaacctgtaaagttgacccttgaacaacacaggtttgaacaggtccacttacccatagcttttcttctgcctctgccactcctaagacagcaagagcaattcctcctcttccttctcctccttgacctattcaacaagaaaatggcaaggatgaagacctttatgacctttctcttccttatgattttcttaataactttttctctagcttgctttattgtaagaatgcagtatataatacatataacaaacaaaatatgtgtttgttgacagcttatgttgttggtaaggcttctgttattagtatcctgttagtagttaagttccgggggagtcaaaagctatgtgtaggccaggcacagtgggtcatgcctgtaatcccagcactttgggaggatgagacaggcggatcacctgtggtcagaagttcaagaccagcctggccaacatggggaaaccctgtctctaaaaaaaaaatacaaaaatttgggtgtggtggcacacacctgtaattccagctactaggaggctgaggcaggagaatcccttgaacccaggaggcagaggttgcagtggccaagatcgttccactgtactccagcctgggcaatagagagactctgtctcaaaaaacaaacaaacaaacaaacaaacaaaaacagaaagttatgtgatatgtagacgtttgcctgtgtaggacattggatcccctaacccttgcattgctcagaggtcagctgtagcttctgtacaggcttgggttctatacttgccttttctcttccttacaaaaccaatcaaaatgagtttcttttccctgtaactaaatttccttgactagaatattgattactgccaattcccacctttcctgtaagttgtaagttttagaatctggttgtttttttttattgggaaatacaattgatttttgtatgatcctaaaattgctgaactctataattgtttatttttagattctgtggaccttttaggtagttaataatcatatctcatgcttcaaaacccatgtaccttgtgttagaataagataggataggataggctctggtaacaaataaaattccaaatctcactacctaatgcaataaaagtgggaaagtcaaaggtggatttggctgcccttctccatcttatatcagtgtcagatcatgataggggaagagcatgctgcagagttctgcaagaagcttttaaggtccagacctggaaatagctgacattccttcttctcacatcccattgataagaatgtctcataacctctctatttaggggcagggaaactagcaactgcgaaaaaagtaaaataaatgaatatttggtaaattataataatctctgctgcatagctctttttatttccttatcttacattgcctaggattaccactacaataataaatagaatgcatctgtcttatttgttatattaacaggaagactgctaaagttttatcattaagtatgattttgctatatgagtgctgaatttttctcttgagatgattaaatgtaaaacaacttttctaagggctaaatcctatatggtcattgctctggactgaatgcagttgcccactccctttccaaatccttacaatgaaatcctaaccctcaatgtgatgttattaggaagtggtaaggggacaaacaagtgaagagacagatacactagagtataagatctatcaagtaataaaggtggacctgtgagtaaattcaaaccatttttctctcttgagtagccatgcttatgacaaagaaattttgaatgccttgtgggttgtttgtttgtttgttttgagatggagtctctctctgtcacccaggctggagtgcagtggcgtgatctcggctaaccgtaagctccgcctcccgggttcacgccattctcctgcctcagcctcccgagtagctgggactacaggtgcccgcaaccacgcccgtctaatttttggtatttttagtagaaacggggtttcacagtgttagccgggatggtcttgatctcctgacctcctgatctacccgccttggcctcccaaagtgctgggattacaggtgtgagccaccacgcctggcaagaaattttgaatgtcttgttttcaacaaatagttttaatttaaatcgaaaagagtgtgtaggtatgagttgcgaatttgtaattcatttgcgattctggtattgatggattgtcttatcttgtacaggtcatttgggccctatggactttaggctcaacaacaaaatcagacagttggagtacagtgccagtcacaatttttagactgtttaaccctaaatgtctttctaataggccttatttatatgagaacattttatagttaaccacaaatattttgtctgtgtttatcaagagttacaagcatagcagccctttctttactgaataaaagttcaaacaaattggattcatctttatttggagctgccaattaaagtgggatatagtatagttaagcagtactcaacatgtaggccactaatctcttagggtcccaaacactctttcaggggctctgccagggaaaaactatgttcatactaacagtaagaacttacatgtctttttcaccttcatccccttcatgagggtacactacagtggagttttccagaggctccatgatgtatgaggatgtagtcactctgctggctagtcgtatacatgtctcagtattcttttcctttaaacacttctctactttaattttcaatatggtactattgatcgatataaagatcagaaacaaaagttctttgggatcttcagttgtttttaagaaacaggggtcttgaaatgaaaacactggaactactaatacacttcacaagtacattttacctccacatagcacagaaataaaatcataaccctgtctcttgtcagcagtatgactctaggtaagacatttaacttatctaagcctcaatttccttatgtataacaatacaaatctcctagcttcatgtgaagatgaaatgggatacaccaagtctgacatagtaggagcaaaaactttgctcacaaataatctaccttaggaaggatagacaagaaaatggtaaactggttgggtgcagtggctcatacctgtaatcccaacaatttgggaggccaaggcaggtggattgcttcagcccaggagttcaagaccagcctgggcaacttagtgagaccttgtatccacaaaaaaaaatacatatgtgtgtgtgtgtatatatatatatatatacacatacacacacacacacacacatatatatatatatatacacacacaaaaattagctgggcatggtggcacacacctgtggtgactcaggaggctgaggtgggaggattgtttgagtcttggagacagaggttgccatgagccaagatcatgccacaatactccaacccgggcaacagagtgagactctgtctcaaaaaaaaattaaaaacgaaaagaaaatggtaaataaataacttttgttaccataagggaggagaactaaacaactggggcatgggggaggagatggggaacttttcattgttgctgcacccttcacttagaaggtccagtttatgaaaagtaataatttagttaaaaccttcaaaaatgatttttaaagaatttccctgctcctcatagatatagcctggtagtttacataccacttcattttctatgaagtactgttgttgcaaatttatctatgcaaagagctaagcatgcaatgattgttgctgtgggtataaaatactgctttgctaaggatactgtagctaactcacagttaattggctgaggcctgagcacacccatatcagtttgccatatacagatttttggttaacttgatttccatatgcaaagtgagaagaaagttctaattcatatatatatatatatgtaaaatatctttctctcctgagtcatcaatctctacctcattattgaaaaattgccatcaatataaaaatatactcctggtatctcccattttttaaatatgtgactccacgggcccctccagctaccatctcctgttcctgttcccctttacagtttacagccaaacttctcaaaagaatatattactattccctgtttctacctctacacatctgttctcccttccacccactccaaccaggtttctgtccttatcactccattaaaaggctcatatcaagacgatttgccacgaaatcaagagctcttcctatgcacagcttccttaacatttcagcagcatttgacactgcttaccacacttctttaaaaaataccctcttctctcagtttcaaggagaacacactgtattggttttcttccctttattgtcctggtctcagcttctattactgatttcctttcggctgctgtccaagtcagcctcatcctgcatctgccactgagtttggtcctgagctctctcttctacttgacctacactctctccttagactattcctagactcattcaagtctacttcttagacttcactctacattcgcttcttcaccccagcccttcagcttaaattctgtccatattcactgataatacaaatacttttgaacacttactctagcccagccacaattagaggcatttggggtttagagagaatgaagtagatgcaggcctttgactctgtggagtttacattctggcaaggaaagacagacaacaagcaataatcataaaaaaatatggtatgttagaaggtgatgagtgcttaagaaaataaatcaggataaaaagaatcaaaattgggaggagacagggaggagagtgggtcagttgcagttttaaagaagagtggctcattgagaagatgagctgaagttactcatgcaaacctatgcataaagtgggttgcaggcagagaaaacagccagtacagaggcctcaaggcacgagcttgtttagtatgttttaaaattttcaacaagactagtgtggctgcagtgcagttttcccaggggaaaatgataggagacaatgtcagaaaggaagtggaagggtgggcagaaagaacaggctttgattatgaataacttgaggaactagaacagggttttgagcagaggagtgacatgatctgacttgtgtccaaaatacacttttgctatgtggacaatgaggatttaaggttaaaaataggctaactggctgggcacggtggctcacacctgtaatcccagcactttgggaggccgaggagggcacatcacaaggtcaggagttcgagaccagcctggccaatatgatgaaaccccatctctattaaaaatacataaattagcctggcctgttggtgcttgcctgtagtcccagctactcaggaggatgaggcagaagaatcgcttgaacctgggaggtggaggttgcagtgagccaagaggctgcactccagcctcagtgacagagcgagattccatctaaaaaaagagaaaaaaaggcaaactgaggctactgcagtgctgagagtgggaaagtatggcttggatcagagtggtagtagtagatgtggtgtgaactggtaggattctggatgtatcttgaagttaaataaatccagtcctatttcctaatgagtagagtagatgtgaaaaaaaagagaaaatgaatccaaagtttttggcctaaacaactggaagaatgaagtcgtcatcaactgaaaaaaagggaagactgcaggtgaagcagcttttctaggtacatcagaatcatttcagtcagggagactgaacactatgggttttgagatagaaagtttattattattgttcattagagacagggtcttcttatgttgcccaggctacactcaagcttctgggctcaagcaattcttccaccttagccttccaaatagctgggactgcaggtttgcatcaccacacccagctaaagatgagcgctttctctaggaattagaccttacgcaattgtgggaatagctgggaaagtgaagatttggggaggagagtaagaagatgggtaagggagttgccaccatgcccattcaagaagccaaggatggccagccaccttagtgtccctaccacagatgcctatggagaggtctatggaaagcaactcctctgtttagctaccatctctgtggggccagcactaagtgtcaggtggtagacctgggccactattggttaaagagtcagcagctggaaagaagagtcagattggagtagaggagaatgaggacaatctggaacccacttgcacctctgtgtctattcatcttcacatctaacttcaaccaacttcgaagagtaatggccactgatttactttcattctccaaattgtatgtaaatgtatctttaatccagaactagatagagaagatatattactgctatatataacaaagtacaacaaacttagtagcttaaaaacaatttctacttgttatctcacagttcccctttgtcaagagtctcaggccttttgttcgaggtctcataaggctacaattagggtgtctgttgggctgtgttctcatccggaggtttgaatggagaaacatttacttccaatctcattcaagttgttagcagagttcatttctcttgtgtgggaatgagagggaggccctggcttcctgttggctgttggccctcatgtcctagagaccacctagttcccctccacaggggtccttcacaggccctctcatagcatggcagtttacttcttaaagaccagctgaaggatttcactttcagtctgctgagatggtgtctgccatatttatggcagtgacatcctagagttttgccattttctattagttagcaacaaggcataggccctgactgcactcagggggagggagaatcacacaagggcatgattcattgcaggggtcaccttaaggtgtgtctcccacagaaggaattctgagatatgcagtttcaccttaaccaatctgacataatacaaacttcaaaaaagggaaaatcaagagatcatatggagacttgttaagtttcagatgtattagacatccaaatgaagaggttaacaagacaattggatacaagactggattttgggagatatgtccaaggaccctcaaatgtgtattcctaattcagtctcttcccaaaactatagtttcattggtctgtctacttgacatcttgaacttaacaagaccaaagttgttccttcccttcccaaatctgttactgctcagacttctacatctcattaaatggtaccctcacctaccctttctctcaagaagaaaaacctaagagtcgtccttcattcctctctttcccttgccttctacattcaatccatcataattctattggttctacattcaaaatataaatctatccccttaattctatgtctaccattaccaccctagtccaagccactattaccccttcctggccttcagcaaaagcctttgaatgtctcccctccctctcttgacccatgttatgaaatggattgtgttcctcccaaaatgcatacactggagccctaacccccaaggtgactgtatttggagatagggcctctaggaaggtaattaagcttaagtaaggtcataaagatgggaccttcatcctataggattaatgttcttataagaagaagagacaccagagatatctctctgcatgcacacaaagatgacacggaaacacatccagaagacagctgtctataagccagaagagaggcttcaccagaagccaaccatgaagacaccttgatcttagacttctaacctcaagaattgcaagaaaatgaacttctgtgtttaaagcaactcagtccatggttctttgctatagcagcccgagtagacaaatgcaatggcctccatatattgttcacacatcagccagaatgagttcttcaaaacctagattaaattgtgtcacacccttgtttacaggccttcgatagttttccactgaaattggaatcagacttgaactctttaccttggcctccaggattgataccatctagctcctgctcatccttttgaccttctcttgggccattcttctctccatcacccagcttggtcgcactagctcctttctgtcaacaaaaacaccaagtctgttcccatcttagagtttctgttctgctcttgctcccaaaactttgtcccctgattcttcacacagatggtgtttttctgcactcttgcctaaatgtaacttcttcaaggacctttcttacccgcccttgtaatcaagaatttcattcactcttccccaatacctaagcccaaacactaattagtgcaccaccctacttattcccttcataatttaccacaatttccaattctctctctatgtcttgatctctctatctccctctgtttatatattgcccatttgtcctcctttataatgtaaaattcgggaaggtaatgaccttgcctcccttgctttctattgtatcctcagagattaggagcatgcctagtgtataagaagctctcaatacatgtgtgtttaatcaaggcttaaataaatctaaagctatggcccaaatgaaaatttttatatgagttttagtacagttttgccactatttccatagaatagattatcagagtgaaattgctgggtcacagtgtatgcacatttttaattttgatagatcagaagtactgctttttaatatttagtgtgactgatttgccactttaaaatttaattatcacaaatttaatttttttcctcttctcctttgaaaaatgaggcatttcaaaaccatttttcccccaatgtttttatggtaactgaagcatcattgttcattttgcaataactctagcttttgctttataggttaaattgatacagccaatttgtctataaagaaaatgtctgtgaattgagtcttctttttgaattgacccctccattacaaaatgaatgatgtattctaaagagaggaaaaaaaaaaccttctcccttttcacgtatcattcttcttttctgagtgtagagagttgttggagtaaaagcattaaagtgatcccagtgttaatatgtggatcctccaagctgaacattttaagtttgaaatttacaattgttataacaattgtcccctgcctaatccattaggtgacagcattagctagaacccagagctaggaatgctttaacacttatgagtacatttgagttggcctcattgttacccagtcgtcaatagtgtccttaacatttccagctgcctcatcactgtttgatatgtacaaggggctgggacaagggtgtagagggttccactcaaacatgtccccagtatcaggagaaaacacacttcaggaaggcatggttctgatagtgggtcaggaaagaaaataggaaaattggttttaacaccattcagttattatacttcctgcctcaattgaaatcaaaagaaaaatccttgtgtctaaagaataattacaaattttgaaatagagtgaacgttccataaagaaaattttaaatcttttttctaagaaaatacttttcctattaccttgtgcaaatggcaatctatacttattggctgaataataattgagttaattaattaattcctggcagatttattatttcattagtcactgaccatgatctataccacgatagggtgaaatttaaaagttcttccattattccttcaaattgcattgcagagctcttcacacataattaggtcttaaattttttgcctaatgttacttattgtttcctaacaaatgcagttcaaaaactttagagtgacattcacagccctctttagtcttatcacaatcccctttccagccacaatccctactattcccctgcaaccatcacacttctgctttgttgaactgccacccaggtatctccagaactttctactgttccttcttctaatccttcatctatttttatctgctcaaattctacatctttcctgacctggatcaaatgccacgtctcaattaagtcttccccaagtcctcaccccctttcttctgaataacaagtatttccttagtatttctctggtgcttattatagcactgccacactgaattgtgtgtatgtatatacattattgatttgctctattagattataagttcctcagagtcaagagtctgtgttacccatcttgtatcttccattgcaattttatagagtcttttgcataaaagatgctcaaaaatgtttaaagaagtaaaccagctgctgagaaactgctaaatgtttgcactgagcattttggcagctgtgtcatcccacttggtgatgctgcctagcacatacacactaaaacaataggcctgaacactaaacaataggccatggtcctaaagggtattttgttctacctttcttgtattgtgagttgatctttgattccggagcaactctgcatgtacgtgtttgctgtcaaaataaatgtcttttttgtctcaccagctgagatacatttaggtgaagatggcactggtaaaggaagtgtgcaggtgaagttggtgaaaatgttctgacaatgtttatattttgcaggcttggaagtctcatgccaagtgaaccatggataagtattcaagtttgatatttgcctaatgcgtggtaaaaaaataataataataatttctgtatcaagactgatttgatggccaggctctgtggctcatgcctgtaatcccagcactttgggaggccatggcgggtggatcacctgaagtccgaagttcaagaccaacctggctaagatggtgaaaccccgtctctacttaaaatacaaaaattacctgggcgtggtggcgggtgcctgtaatcccagctactcgggagactgaggcatgagaatcgctcgaacccaggaggcggaagttgcagtgagctgagattgcgccattgtactccttgcatttcagcctgggcgacgagagtgaaactccatctcaaaaaaaaaaacaacaacaacaaaaaaaaaaaactgatttgaattttgcaaaatagtattagacataaatatgttgatcaacttttggggaacttaaaggttaactttataaatggagaggaaaaatcgtcctgcagaatccacgcctcaaattatctggctttcaaaaatctagaaaaatattttgtgttgatttgtctacattacgacatataaaagtcatccaattgcctggatgtactctatccaaagtcatggcttttagataacagttaatgggagctcgaactgcttctcacattttatttgtaatctaaatcagaaactctaggtctcaggtataatcattccttatcattaagacaaaataaaatataattaatgataaaggatctcggcagttcaacttaagaatacagaggttaatatacttaaatctagattcttctgaagttctctttgcacaaaaaggtgaatttttgatgtgacttattctctggttcttggtattcatcataactaaggaggcaagggaaccccgtgacttggttgggatgcagaagccaaaactcatccatttcaggataaagagcccaggataagggagaatcataaatgaaagacaaagccagaagaaatcccactggcttagaatgaagttgatggtgaccaggaagattaaccctttccaaaatataatatggacacgtaatactctgttgatgaacacaagagtgcctatacatcattgttttggttcattactgggagcagggtaaaaagattcctaaggtctacagtaagtgagcttagtgaaaatacaccccaaagaccagagggaaagctctggaaactgctggatcatcagatcaatagactcaaagatgactaagttgggaagctttatgcagtttaaacatttgtgcagggagtatccccacacagccttttattgacagctacagatcaatggtaatttttgatcattttcaacttacataaacctattgaccccatggccacctttggggcacttcaagtcatcaaaaataatcagaggagatggtgtaaaattgtcagactgctgaagactccaagtagttgcatatgtccccaggagctgagtcgagaggttaaaatatagttcaaattgccagcagaacctcaactgacagagtgttccagagagtcttgtctttatgtctcataaaatgaggcactgatttgtatccaaactctgaccttcatgcatataaagttaaagaaggaaaaaagaggctgaatcccattgaagatattagattgcaaagaatggattattcctagtaaaatatttcttcctgtttttctttgttgagtcatcttcttcatctgctgcctaacaaaagtagctgacatgcttgtagaattacgtacaatatggacgtggacatagaatgaacaaagacaaaacagaagcaagtgcaaggtggcaggccagaagtcagggacaacaaaaaatgtagtcaaaaaaatcattaggaagagtgaaaggaaggaaagagcaaaataatggcaataaaggggaagaagtaagagtattgaattaagataatctctatagaggaaaaggagtgagagaagaaggaaagggtgaataagaagaaagagaaaggaagaaacggaagaaaagtgaagcaaaggagtaaaaggaaggaaaatcgtctttagtgatgacttttcctagttagtaagacagaacgctacatctccaaaggaaggaactgaatccaaaacatctaagatccacagtgctcaagcaaatatcctaaatttaagaaaaataacaagaaacttagtacgtaaatgagagccaacccaattcacagagtgaactgcatccaaattttgcagcaggattctaaaatagtgaactttgatgttggaaattcattcaggagagaataatataaattatttcctaaaacgtcaaagaataaattggcaaggattatcttgtcatttttatgttttcttcattttttaatatagcttttactaaacattgacaaaaaccatggctattgtttagatctatttaaggagtctatatgtggtttgtgtgtgtgtgcgtgtgtgtgtgtgtgtgtgtgtgtgtgtgtgtgtgtgtataaaactattcaggaataacaaagtagccagatgcagcagtggcttgcacctgtaatcccagcacttttgcgcagccaaggcagaagggtgacttgagctctagagttggagaccaacctgggcaacatagtgatacccaatccctacaaaaaaaggaaagaaagaaagaaaagaaacattttgttttaattagccacacacggtggtacatgactgtagtcccggctactccagaagctgaggcaggagaatcacttgagcccaggagttcaaggctgcaccgagccatgatcatgccacactccagcctaggcaaaagagccaaaaaataagaataataataataaattaaataaataaataaataatgtaatatgagaacttgtcctcagtataatttcatgatacagaaattacttttacatcccaacatgtggttatttctctcccttttttttttagatacatgtagaccaggttaagcaaaacaactgttgtaatgaccctttgtaggagtatacccctaaaaattttctgtgccaggcatgcatgaacttcagcttgcaacctacaggccatatttctatattagatggtggaggtttggaagctagggcattttgaatacttctgctttcaaggatctgagccgtaaatgtttattaaacgaatctataatgaaatcagttttgttatttttttaatggttgcctggagtgtgttggatgactgaatgccagttgttaatcattaagtactcatgttaccaaaagtgtttgatagtattgccatctaggggctgaatggaattctcagctctgaaataaattataattgagcaggtgcagctattgacaatatacatatgtttttgctttatagcccacatgcttttcatgtttcttatgacaaaagcttatgaaaaaatgtcccccagcagcccaccttttttatatataatctgttagaggtgattactatttgctttggagcgtatgcttttttggcatctattactgaatattctgaacaaagaattattcttttttgcattattaatcttgcccatgtttgccctatttccacagaaaaggaatcatttatcagaaaagagtgtttgtaatcgggacttgtagcatcttcagatttaatattcattatggtcattctagttctgtgctatatttatctaaaaggccaatccaatgttatggagaaataagtttttaaatatttatgatctaacttttaatattttaaaaaagagaaattagtatttctgtaaaatttgtttcagagtctgattgctcagcaaatgtttaaatattaaaagatttcaagaggttagcgtgtaatatcataatgggacttattgaaataggaaaattgactttacaagtttttgatatgtgaaggaaattgtattttctctgcctatgtttaacacataacaagaaataacacagttaaaatatacagccaataatgtcagaaaacagcaccaaaacctatttctacattgttttgtttttgtctaaccagtttgtttggaaaacaattctgtttgattttgtcatcttgttttagattttatccaaaatgatatttggatgcccccacacataattttttctgatgttcttgggtgcctactttcagaaataactttcactactccactttatattcttcttcccttgttcatcaaggaaagaagacaattgaagaccatgtatcacattcaaacatctaataaaccaaagcagatcattgaatgtaaatatcctactaacccagtcaaaactttctcatgatttcttatatccaatggggatggtacgcaacagaaaatgccagtgtgtgtgtgtgtgtgtgtgtgtgttcgtgtgtgtgtgtttacctatgaacacattactaccccacttgcatacataattcctactttaaaaggacatatcctttcagtccagatgtggaaagagcaccccagggcctttagaaacattaggattcttagctccagtttagttatgccaaatatgttaatgctgctctccaagcagaaaaacaaacaaattttaaaaatcctaattaggctatccctttttttcttttcttttaaagcaacaaagaccaaattctccaagcctagctaacaattacttttggtaggtttcatagttttacttatggtgcttttaacaaatgaaaatatttttatatctatattaataatagacttctctaagggtgtttgtacatgtatagttgaattggcttgttactgttttcttgtgtttatttgttttattgaattcgtaagatatatatacatgccaagagaatgagagagggagactgggaagatggagagtcttgtgtacaaacagatttggaaattaggggtgttcaggttaactctccaaacccttaatattaacctggcaggcaattatcccagtctcagacatgcagcttggcaccactgatttccattttgagctggatgcagcactgatctgaagcatcatgttttgtttttttttttaatgtttatatatcacacgctttgggctgcaagcactgaaaagtcaaggatgctatctggtccactttctgagtgtctgaaatcatacaacattgggtaatatattcacggtgtcaacaagaataagaaaaaatgcgttgttttcttaatgataattcaaaactctgctgtagtgtttgcgctgctgttgcctacaagctttggccatgaggttcagagaatgactttccagcaatattgtcagtttcaaaaaaaaaaaacaacaacttaacctgttaattttcttacagggaacaagccatcaagcccacctgtacgggttagaaccattcacaacatatcgcattggtgttgtggctgcaaaccatgcaggagaaattttaagcccttggactctgattcaaaccttagaatcttccccaagtggactgagaaactttatagtagaacagaaagagaatggccgggcattgctactacagtggtcagaacctatgagaaccaatggtgtgattaaggtaatgtctaccctgcataagaaattatgtttggtgttctccagataaatagatgagccctgacatgccatcaggtcactgtgggaaaactcccttcacagcctgtttaattctccttgatagctcctccaggcacttaatcatagatcacagaaacctagcttagatgtgtgatgcttcctataacccaacactgagctaaatgctctccatggattatctcatttaatcctcacatcaaccctactaggtgggtaccaccaaacctcatgaggcatatgcaggctaagtaactgcccaagcctacactgtaagtaattgagttgggatttgaagccaggaactcacatcagaactgaactctaaatgactgtgttcttactgcctcctgaattaccctacccagttatttgcttaagacttgcctaatttatgcttcaaacagagctcattaagcaagccacaggtgtctgctaacttcccaacttctgtatgtagccgtgagaaacaatgttataaatgttgtatacgtatctcaagctctgccagcccatgagtacagggggactgtattttcatgaatagcctgcattttgatgttttgaaccttcagccacacaaaaaccagccttcatctacctctctgatgttcctccccaaggatggtggcagacatacctgttagttcatactactgcctttacctccagtctctcctggccgtggtccatctcttaggccctcatcaactaccttctgcgggctgggactgcagagtcccccagcctgcagctgctatagacacactacccttttctttgccactccttctccaagaggcagactcccacatcaattccacatcacagggttgagactaagctgttacttttaataaagcctccctgaaaaccctaagagagggatgacagcaggaaattacgtgcagcaataactaagaactgtaactagagctcacagtcccaggtccatcctgtgggctgcctctctgcctagcttcaaggcctgctgcaagtagcagtagcaagctgcttcccaccagcctgcctacatgtggacagaagccagacttctcccccctggggcaagaggcttgagccttaggattcatgaccttaaaatccaaatcacggccccaaggcacccatcagaaaagaaagctccttttccctcaaagcacttctccttgtgggtatttggagtcatgagagcatctgcttcttggtggcataattgacaataagaatattgactccttggacctttatttacatttcaccaaatattaagcaaatatttggtgaaatacttctactaagtgccatatacttattcaagagtgaacaagacagtcaggttccctgatgttacagaccgtgtgtgagtgcacgtgcgtgtgtgtgtgtgtgtgtgtctgtgtgaataaatgtggcagagtatatgaatggtgggggtacagaaaagcaaacaataagctagtaaataaataagcaagggaattactgagagcgatgaatgctataaagaaaattaaatagaataatgtaattatgcctgctcaggctattttagaatggaatatcatttgaatcaagttgacatttgagctgagtcctgaatgacaagacagagttagtcatgtgaggatatgggggcaaaatgttccagacaaaatgaacagcaaatgcaaggcctgaagccaggaatgaacttggtgtattcaaggaaagagaagaaagctagtgtgtatgaagtatttgggagaaagaaagatggcactagaagaggttggagggactggtaggagacagattgtcccaacattgtaggctgtggtaaagtttagaatttgttccaagtgcaatgaaaaattactgaaggctttaagcaaaggaatagcatgatcaaatttacgtttttaaaaatcactctggctaccctgtggaaaatggactatataaggaccaatggagtttgagaactattaaagatttcaaggtagaattgaaggtgggtcaaattagagtagcagttgtgaaatcatgcactataggtgaatcgaagatacattcagaagatagagatgacaaaatgtgttaatgagctgaatgagagacatgaaggaaagggagcgctttgagatgagttttgggtttaggctttgggctattgatgaggaaggggagactggaagatgaacaagttaggagcaagtagatagtgtgaggtacaagtctaaaactcctgagagtgttctttgctgggataaatgttcagaatccgttagcaggtggatgttatataaacccatggtgccagaggagatcagctatggagagaatgtaactcaacctgttgagagtctgggatcaagccctgaggcataaatgtgggggtcaagaggaggaaagagagccagcaaagactgataagagggaactaggctagaaggaaaagtgcatgagtggagtgtccaaaaagagaagagaaaatatgccaaaatgttgctgagagcagaagtaaaatgaaggcagagaagccaccccgagtatagaaatgaggaggtcactgtgatctcgacaaggagagtatgcagtagaatgggaaacctggttggcatggctggttgaggagagaatggcaagggaggaagtaggacatcaactcattaaagccatttagatgaaaagaaaagcagagaaatggagcaataggtggagactgtgggatgggaagttttatttaaaatcattgaaaaatactagagtacatttaaacacgaatagaaataaccagtagagggagataaactggtgacgtaggagataatgagaataacggcagtagtgaagtcttggggaaggaggaagggatgggatacagcgcttaggtggccttcagtaggtacagagatatttcattcatagcaaaaggaggaaaagcaaatcatgtaagtctagattcacatggatacagaggtcagaatatataacatggaggcattcttctctaactgcttctattttcagtgaacgatgtggttatgtcaacaatcaatcaacggtgagggagggaagagggtgttagtggttaggggaaaggaagaaatatgaaataatcacctgggaaaatgacagagcaaaagcatgagggaataaaataggattacaaattggtaatcgcctatttaaaatgtatggatagaagtttaaagtgagaccaataaaaatgtttgggtgtttttctacaaacccatttcagagcttgagtatagagggacagctaaattttacactaattagagatttgccgggtgaatatcaggggcagcaaggggtgcttggggggtcacagaggctgcaagctagttatggaacctatgctcccttcagaagatatggcagtccccttcccacatgggggtggtcttgccctgggtcctcaacaagaaaatcacaccaacatacaacattccaacataaagaggtttccaaacttctaggctgtgtaatcttagggaaaaaatggagtatgttaacaatttagtctaaattaagcttgcccaagaaccacttctgggaatgtttcaagggtgtgccttccaagggctgtaaaatgtgtcctgtcccctcttgagagtcaccatgatagggagtcatcgaaaggagtgtgtcatctctctcaggtttgttggagcaggaaaaggttggaaaatcactgttcaaaaacacctgcattcagattaacttacttcccatctttcaaaaaaaatgaaaacttgctctacatttgtacagtataataagcattcagatgtttttttccagaacaaaagactactttgcccccaaaggagcaatcagttcttccatggcctggaagagaaaacagggtgtttttttccatcccctagtcataaagatttatatacatgtatatatgtacatgtatatatatgtatggatatttgtacttatgtataaaatataggtgtctgtgtgcctaaacacacacacacacaagcatactctttcagccctggcactctgtaacaacaaatgattaagcgttgtaattccatttcccagcaaatgccgtggaaggtagaccctactttagtcagtatgagatcagaagcagttcatatccataaaacaggagactttaatactattctctactttaaaaaaatacaaataggagaaaccttgtgaataccatttaagtcaaagaatctgattcaatagcccttagttttgagataaatgtttatgtagttcccaaactgaaaaaaaagaaaagaaaaaggcaaagaaaaacattgtttgtctctctgtgggccttatgttaactgaaaaaaatcacatatccccaattaatatcagaatacttcttctaaattagggtcatcaaaataaggaacaagggggtgaaggttaaaaaggggctaagtaactacacaaagaaattgtatgctgcaagttatcccttttgcttctgtccttctgtagacatacaacatcttcagtgacgggttcctggagtactctggtttgaatcgtcagtttctcttccgccgcctggatcctttcactctctacacactgaccctggaggcctgcaccagagcaggttgtgcacactcggcgcctcagcctctgtggacagatgaagcccctccagactctcagctggctcctactgtccactctgtgaagtccaccagtgttgagctgagctggtctgagcctgttaacccaaatggaaaaataattcgctatgaagtgattcgcagatgcttcgagggaaaagcttggggaaatcagacaatccaggccgacgagaaaattgttttcacagaatataacactgaaaggaatacatttatgtataatgacacaggtttgcaaccatggacgcagtgtgaatataaaatctacacttggaattcagctgggcatacctgtagctcttggaatgtggtgaggacattgcaagcacctccagaaggtctctctccacctgtgatatcctatgtttctatgaatccccaaaaactgctgatttcctggatcccaccagaacagtctaatggtattatccagtcctataggcttcaaaggaatgaaatgctctatccttttagctttgatcctgtgactttcaattacactgatgaagagcttcttcctttttccacctatagctatgcactccaagcctgcacgagtggaggatgctccaccagcaaacccaccagcatcacaactctggaggctgctccatcagaagtcagccctccagatctttgggccgtcagtgccactcaaatgaatgtatgttggtcaccgcccacagtgcaaaatggaaagattactaaatatttagttagatatgataataaagagtcccttgctggccagggcctgtgcctgctggtttcccacctgcagccttactctcagtataacttctcccttgtagcctgcacgaatggaggttgcacagctagtgtgtcaaaatctgcctggacaatggaggccctgccagagaacatggactctccaacattgcaagtcacaggctcagaatcaatagaaatcacctggaaacctccaagaaacccaaatggccagatcagaagttatgaacttaggagggatggaaccattgtatatacaggcttggaaacacgctatcgtgattttactctcaccccaggtgtggagtatagctacacagtaactgccagcaacagccaagggggtattttgagtcctcttgtcaaagatcgaaccagcccctcagcaccctcagggatggaacctccaaaattgcaggccaggggtcctcaggagatcttagtgaactgggaccctccagtgagaacaaatggtgatatcatcaattataccctcttcatccgtgaactatttgaaagagaaactaaaatcatacacataaacacaactcataattcttttggtatgcagtcatatatagtaaaccagctgaagccatttcacaggtaggtagccatgtctcggttttctgagagtaagccactgctgacctttctattgcctgagcccttggtcagttctaatgaagactctaaaaatgggatgcaaggtgtccccaacctccatccacctaaacgtgcatagtagacaaagcacatcctcacccaagcaaagcctgcttgcataacctccagagagcagaattctttcaggtgatgttttgagagtcagtgtttcagaaaggtttgcaatgcatcctggtatctgaaataagtaggacagagatgaggctagtccccctggaaatacgcaggcccctggacagttctgacagccccgatagggtcatctggccagactgtgaagaaaatgatgtattattttaaggttaaaaagtgccaatcaatgagcgcaattaccagccagagttagactaaaacaaaatttgtttcgtgaagagccttcttatcaaatccagcacttcttccaggaataataaggcttctctgactctactttcttatggtttctcaggacagtgccactttgctagctcatgttttcctagcggtcccatctgggctctgtgacatgcatggaagtgcgttgttctccacacaaaagaatcttgcccattgtttaaataattgtttggcagttttccccatcacattttaagtaacttacatccccagagagaagggtaataagagacattttatgcttaaaatttagtaaaatgaacagaatcacttaaaaaaattaaaggctgaaagagtgttgatttccaactacctcaggtaaaattcagctattattgtaatctagtgatgtgtagattagatcctcctataattacctctgatatatagtgctgttgaaatgaaacattcgtggttttatgcatctactcatgacaattatttagggtctattaaatattaaacagtaattaaaacttcctcaggtatcctctgcagctaatccacatgctatgtgagttggcttttatattaccttacactgattcagggcattaaaaaggtccactgtagctgcagagctgtatattctagactggcttcctctttacctgactgtacctccaactttcaaaaaccatatcaatttgctcccttttgaaactcttattcaaaaagtattctagaggtgaaagagtttgtccaggcatgaaaggaatgctttttccaggctggaaagaaaagtttaatttatctgataaattgcaaggatatttaagaatgtgagagaaatctcttcattatccactctaactgaatctgtaagtggcattgacataaaacagagtatcacttctatatgaagttggagttcatgcgtggttttttgtttttgtttttagtggattaatgttcactgaatattgcaaatgtgtgtgtcctcctttcagcacccccagctggtcagtaagaagaaatagtctgggaaagtcctaagtagcagaaggaatccagcccaaaatttaaaaactaccacggataacccagaaaatgaataatctttatgtgggaaatcaaaattgacttcacagaattgcttagaagtcagatctaccatacacagctatggatttgatcaccaataaactggtagccctgtcatggtggagatcggcatgagaggagaaccaggggaggaggagaagaaagtgggaataaaataagtcacaaagggaaaaaggtgtaattaagaaagcaaaaaggtggaagagacagaacatgtacaagaacagaaagcagtgattcaaagagcaaagaggggaggtagaaaatagaagaggaaaaggctagaactaaaaggaataaaggtagaaagaagatagctgggtgcctgcgggaaaattgaaggtgtcataaaatcaatggtggttgggaatagagaaaaaagtgctcatttacagccataggcactaaatactcacaaaaactcattttgttggaaaggagaagtccctgctatgtaaatagaccttttcaagtagcagagaccagctatgaggcaaaacataattgattagttgaatttaactggatggtgataaggtgtcttcatgattgataatctggtgtgtagttgggttaactttggccccgcaaggtctttgtatcatgtaagggaggctgttttaagctgttaggtatcaggtgaggggatttattaccactgagaccgtaattccatgatgttccttcatgacctggaaacattcctgggggatcattccatgatgttccttcatgacctggaaacattcctgagggatcatttagctctagctgcaaaggtaggagtccaggactgctgagaactgcttcatactttctaaggtctgcattcttcattgctatgttaagtaattctgaagagtaccagaattttcatgccggaaagaatcttgagagttatttattccatacatccttgtttaggggaagaattgcactcacccctttcgaacagatcaggaactttagtttagaaagccagggggattttgattgttcaaaaatttccatggaaatataatttttttttgagacagagtcttgctctgtcacccaggcgggagtgcagtggcgcaatctcggctcactgcaagctctgcctcccaggttcaagccattctcaactttgttattcttaagaattagctgtgaataagaatacatgtaagcttgtcttttttttttaaggcctggtgttttaaagattcttcccatgaaaatctattttgctgaaaatcactaatttctgccttatgtcctgaaggtatgaaatacgaattcaagcgtgcaccaccctgggatgtgcatcaagtgactggacattcatacagacccctgagattgcacctttgatgcaaccccctccacatctggaggtacaaatggctccaggaggattccagccaactgtttctcttttgtggacaggaccgctgcagccaaatggaaaagttttgtattacgaattatacagaagacaaatagcaactcagcctagaaaatccaatccagtcctaatctataacggaagctcaacatcttttatagattccgaactattgcctttcacagagtatgagtatcaggtaagaaatgtgtattataaacaattcgagctgattgtttgcacccgtcagcacctgcctgtaaaaatggtgcacaatttgaaaaggcacttaaagaaatgtaggacttaaggagaataataatattccttaaaaatttttaagtggtaaatgaggaaaaaccatgttcattgcctttttcattttcttggtttttgagccatattatatacgttgtttttcttaagtagattccaggtgaatttgcatttcttattagtaaagtggtttctgccattaagattccctctgtcagcgttgccttggtaggagacactccttatttaaagatcactttgaaaataactcattactcgtaccaaaataaaatcaaatagcaaacatctctagcctcggtgctcaagaaagatacagaatgttgaaaaaagtctagaggaatacaactcacctgcccatggcgatgagttaagttttctctgaggatggcctaaaaaaataagactgcattcttaaaaagccaagaattaagaataatattcagaaaatatggtgaattctgtggaggacttctgttaggtttgttttgttttgccatcagagtccatttgcattcttcttgtgataacaacctcatttcctgtgggagaatgtgcttcccccaccctttgctcaggcgtggtgggagtgtcaatcaatgtgtcaggctgtcttctagccaagtggtgggcacatgagccgctcagcccctcagatttgcctggggcttgatcttcagcagagtgactcagaattttaaaaggtggaggtgagaagtcgtgataaaatatccctaacctcaatctaaaagtttttcttttccctgctatttccaagcatggttcttcaaccgttcttttaattccataaactcacagtaaattctcatttgcttaagtcagaatcagtgcctcttgcttgcagtcaaagaaagcttactgactgatgtaagcacttaagtgccaggaacaatgccaacagaaattttctaaaagaggaaactgagccttaaaaagcttattataacatgaaatactaaaaataataagtcaccaaaaagatagtgaccaaatcaatgagtacagtgaatacagggaacattttaagcatgaaaagaatattttaggacaataatgtatgggacaaattaccgaattaataagatttaaaaatataaataaattctcgaatggtttggaaaaatacacagatataaatccataatcccttgtttgcaattccaagtctaaaaatctcttaaaagtattttcttgctttaccacaagtcatttggcaacaaaacccaatctaaacagacttgagactatttacagtatttatttatcccatttaatatgaatatttatatgttttgctacaaaaatattgctttattataagatggctaatcagatcatggtatggatattacaaaatatacagtatatacattttatcctatttcaaaatctaaaaacaaaattattttaaaacacatcaggcccccaagggtttaggataagaattgtggtttatgtcataaaggaacaaaatacttaccgatgccaccatcggaaacgtaacactgttagaaacagccagaacctacgtgcctgcccttttgttcttttctcattacctttattgagaagtgtcacgttatcaagctgtcagttatctagtctcccttacaaataaaaatggtaccttcgtgagagagctggatgaaatcagcataaaatcttcagccgctaattaaacgcaacttaatgacccatatataagaaacacaaactttctctggtattgtgttgtgtcattgggttaaattctggtcacatgatctgtggaagtctcattccagtttttgtttgtttgtttgtttctttgttcgagacagagtctcgctctgtcacccaggctggagtgcagtggtgagatctcgagatctcaactcactgcaacctctgtctgccaggttcaaacgattctcctgccttagcctccagtgtagctgagattacaggcatgcaccaccacaccaggctaatgtttttttgtatttttagtagagacagggttttgccatattggccaggctgatgttgaacccctgacctcaagtgatcagcctgccttgacctcccaaaatgctgggattacaggcatgagccaccatgccaggccccatcccagttttctatggaatggaaagctccaagcatgtgccttgtctctagtcagatttttcatcaggcactaaggatgactaagaacaaagggacccacatttcagaggagaggcaagttaagaaccttaggctgtgtggtttcttttgtaactgttactatcggctctgtgttacactcctcctccatactcatctcactcaaatgaaagtatttaatttggtttttgatctccaatttttatttattagctaatcccacgtagttacaacataaggatagaaaacaaagaaaatcaaaatctagcttagcccaaaggcccagttcttatggaaaataatattttgaaaagcatagattaaatgctgaaataaatgatcagaaaatattagtttcatttagcctgtgtaaatattgagtctatgtggaccctgagtaatcttacagaagtcatttaggaagttatatactaaaacaatttatttttctttaacaaaagagcatttttgtatttgtgatgaatttgcattgctctcaaaaccacttgagggttacttcatctgcaagtggcctttgaaaataccttcattgtcctatataaatctgctcacccagcaactgacagtgatttcacccttctgcagaggagtgtgtttttgaggtaattgtagattgtagggaataaaaacaaagacctgagaaacttcctagcagtggggaaggattaatcagaagatcgtgaggatgtatagttggggaggttgccacccacatggtgtgccttgcaagtatcagctggggctccccaccaccttcctacactacattacatcattgtactcatttctggttttgagttaaatcattgaaggcagttgttaaaatttagttatgtgaaaagaacaagacagttttcactagtctaaatcaactcattccatcagttggccagtgatagaagagggtatcgcatggataagttcttttgtttttctttcttcttttttttttccttcttctttgtttttttccttcttcttctttttctgagacacagtctcgctctgtcacccaggctggagtgcaatggcacgatcttggctcactgtaacctccgcctcccgggtttaagcaattctctgcctcagcctcctggtagctgggattacaggcgcccgccaccatgcgtggcgaattttttttgtatttttagtagagacggggtttcatcatcttggccaggctagtcttgaactcctaacttcgtgatccacccacctcggcctcctaaagtgatggatgagttctaacgggcaggagggtcaggaaatatctggagaaatggatacttatagagagggaggagctactcactgcagaaaaccaaagagggaaattaaatgagcagcaaatgtcactcacctcaccacaattcatataaccagcttgataactagctcctttgaaggtgagcaaaatccatgtgatatcacaagcaccttctaagtgttcactaatacttcaatatggaatgccctaaaggtagcatccccactgtttacagtacaagtggaggacctaagagcttgttcaaagggcagactcctgggtggaatgggaagggaccccagcaaccagtattttttttctttttttgagatggcatgtcactctgtggccatgctggagtgcaatggcgcaatcttggctcactgcaacctccaactccccggttcagtcaattctcctgcctcaccctcccaagtagctgggattacaggcacacaccaccacgcccagctagttttttgtatttttagtagagatggggtttcaccatgttggccaggatggtctcaatctcctgacctcatgatccacccgcctcagcctcccaaagtgctgggattacaggcgtgagccaccgcgcctggcctagcaacctgtacttttaacaagcagcctggatagtccacaacccacttttttttggaaatactgcctcagagggtgagacattgctgctatgctacttaagccttattttcaagcggtgattttctgaatcagtggttctcagctttgtgcattagaatcacctggggaaatttcacaacattctgggtgctgatacccagtccccattcccctgtagttctgattctgggatgggttctggaatccctgcgattcaaaaggttcccaggtgattctcatgtgcagccagagttgagaatcactagcctaaactgtcataaacagcccaaataagtgaagccagctccccacaaatgcctaatttacatgatgatcattgataatagcctattgacgttggtctatcctggctttcctaaagaagggtcctattgttttgatgtgaaactagaaaggagaacagaatatattatctacaaagtccatgtctcagctactcatataatttattttaatcttcctcatggattttatttggattttgttattgttgttttattttcttttgtttcttacttgggaggtccggtctttggtggtaagagtaaagttcaccatcatttaaaacaggggatttttctagtttgagtcatttcagcatagcttccagaattctgggattctgaaggataacactctggaggattagctttaataaagccagtgagatctaaaatatgaatcaaaaaattaggaatattactttttcttgttttccacaagaatgggttggtggctttacagagtgcactgcagggtcccattagaaagcaaacattctctgtgaatttcaaatgcaacttagtttaccaaaatctaattctcaaacaaccctgtgaatgtatgttccatgcataaatgcgatgcatctgtactaaataaaattcttccattgcacagacctcttccttaaacagagatcacagtcttgcttgtgctacagaatatttacaaatccaagaagatttttttaaagacaataatcatttctatcttcaaccctttcaaaattgggctattctaatacatgcagtgtgaacctccaaattctatgtggagcagttcttaactgtttagcagcaaattaagacaatatttttcccacaggctttgagagggacctgggtgtgagtctactctgttaagacattttggtttttacctttggggagtgagctgaggctaatgaatagctctcagtaattgtgcattcatattcatactcttgcttaaggcaaagactcaccacggatttgatagggcccgccaccaccccccctttcactgattcatgctgtcagtgacttaattagttttcctgaaactatctcactttgacagatttttgcggtaagcacccacgcacactcagggtctctgaagcattctggtgcctcatgactgggtgactgagaagcagtaggtcagtcttagaggaaactctgtgactcatggcatggggtctgaacttagggctagtgctgcaggagcccatgcagaatggcagtctgctgctttctaacagaccaacactgcccccaaacaagaggatggaaagaagggctgtggaggagacacagaaggggatcctcactgttgctgccagtggcagctgcctgaagactgccagaggtactgtggaggccttccctgcaccagcccccaccataggctaccaaatcgttggcgatgagttagaagtgggagggagaaaggccaacatcttctactccttctctcactacttctggatatttgagcacattaacctctttgggcctttcctcataatataaattaggcctgctatgatggaatatcatagactgggtggctttaaataacaaatatttatttcccacaattctagaggcgggaaagtacaaggtcaaggcacctgcagattcagtgtctggtgagggccaccttctggcttacagataatggtcttctccttatatccacatataccaggtagaagaacactagtccccttcatgagggctccaccctatgcaacctaataacctcccaaaggcctccataccatcatattcaagattagccttcaacatatgtatttgaaggggacaaaaacagtcagttcatagcactcatctataaaaggaagcaccctccagctctgtattctatgggcagagtagtggtaagctacaggtatataatttttagaaagtctaatcaaactttatcttctcttgattggtttttgtaatctacagtttgtaaaaccctacaaaataaattctcacccaaagcaacagaattttctaatggtatttagctttaagttgtgttgatgcaagtgaatgtatgaaatcagcttcagataataaatggatatatggttattcatcaccaagatggacacatggaaatataattagttgtgtctctcattgaaacctaacatatttattcactaatatattttttaaagtatagctatattataacatatgaatgtaaataaataataaacttatttagttagctacaaataagtctcatttatgttcctgagaaaacccacactatcaaaaagttgtcatgactatttcactacaagtaacagaaagccaatgtaaactaagttaaacagaagggaattgtttctgctctcgcatctgggaagggcattgaaggaatcccttgaaaccaaagaaaagatatgaacaccaggtcctggaaacctgggatgcaggactcggatgatgtaggattcattcattctgtccctccttgccccatctcagcttgtctctgtttggcttcattctgcacactttcaccaggcatctgaggaaatcactcccagattcaagccctttctgtgcatcagttttcttgtctttaaaatgtgaatagatatagcattggactcataggcttgctctgaggttaaatgagttaatatgtgaatgtgcttggaacagcacctcatacatagaaaccacttcgcccatataacaataatgattattattattacccatccaccttagagtggaaagaggactataagtcaaccaatacaggactctgactgatccttttgcactacctgccttcctgtgaaccaagagaacagaggactatgattgagcaggtgtggtcgcagggcccacctcctacaggcagggctgcatgaggtatgcgggaaatgcttccagccagaagcaagaactgccctagcacgctacacacaccaaccacgggaacaagtactccacacctgtgagatattgacaatccttgtgctctttcacattggatgctcacacccttcctgttttccaaatgaagaagctgagttaagatcacatagcttgtgcaagaaagatacttaatttctgataacttcacctttctcatttaaaaaaatgggtgtgttatgagaactaagaaatctgtgtgtctagtaggatgcctgctacttagtaggtccatgcccccatccgatccccccaggatctcactagttaaaagaaggagaaactttcattcaagactgtaaaaaagccaggttaagacatttcttttgtctatatcaacaagtcattgataaaatgttagagtgtaaaaatctcaatcaggagtacagttgcctctaaaggtgtgatactccttccgctaggaagttcaaccctcctcatccttgccatttctcttctcagaaaaagagtaatttacccacatacccatgactaaaattccaaactctgatagtctgactctacttttatgcaattagctacttgctttgtattgcctgttttctattgctgtcacccttaccccatctcttttctatatcacatttagagaaaacatattgaacacattttctgtttagttttggacttgcatttaattaggtattaatctcactaatgtatttccgaccagcatggaggtttttgtctggttaatttctcccacaagaactaagctccccacacccaccccaactcccacagctcaaggttttaaatgatttattgatattgtctgactcaggcagtgtatttattctaaaactttagggcctgagtgcacaggttagactgaaggccactgggacatttccatgtatagaaaactaaagttcgccactaggcccagggcctgatcattttttgcatcgagccttttgttcccacgggagatcatttccacctgtcagtgtgagcacattcaggagcatgctctaattctttttgttcttgttccatctctcatggcaacccttaggactttattctgaagcttctgttgttggcaatcttcatggcgcctttgggacaagttatccatgtgaagatgggttggttctcaccctcttgcagatgcaactcagatttatatttcacttaaggtgatgttgatcttcctgtctctgtgttggaagtttgtttgctgaaaataaaatgttaaacacaacagatgctcttcaactgaatgtagataatatgccattccagcctgccctcatggctcttcagatggccatgaaaacaaaggctcccaaagtcacctaaaacttaggtcctgtaaaaacatctaggaaagggtaagatgtgttttacttattttcctccatcctgtaaattgagtatttaataaactgtccttattaagcacctacaatgttcaaagtgtatacctagttactaggattgaggcaggaggctaaaatccatgcactctccccttcagggacttaaattatagttgataagtcaaataaagatgcccatgaataatgtatccataaaaatatggctaggaacgttgatgtttgcaggatctgagtgatggcaaaacagacccagggaggaagaagcagcttctttatcttcagggacagcacgatttccacaccaaactctaaaggccactcttattctactctctggccagatggttttgtgcaggacaggtggcaccttgatattaaagaggtacttgactaaaatcattccacagagacatgaaggggcaccatttctctgttccttcagtcttacaaaaagaaatccctttctaaatctccatccttatgtttagaagcctctcttagcccacctactgttattggtacccatgtaatggttcaaaatattctccactgtatcaatcgggatctcagcaggaaacatatggcacattcaaagggtatttgaagaaaatttaatgaagaggctatttatggaggtgtgggtagaattaagagaatcaataagggatgttgaagtacccagggagtaggaagagccagaagctgttaccttctaggcctgcagggacaatggaagaaagtgggtcattgagaggaaattcagccttgtcaacatgcagtgccaaagagaggagcaggagaaacaaagaacctgaactctctcttccctttgatcaaaacctaatggaaaggagccagaggagaaaagattccaggtgaggcagtctgatgaagtcagcattccagagtacagaccaagccagagaagggcagaggatggatctggggaaaaaccagctcgtcccccacactcagattgatgctgcttctcaaccagtatataataatgccttcaccagtagaatcctttctgggctagaggatcacctggccagctttggcttgtcaatctatgattattgataaaccactaagtaaatctgaagacttaaggaggattgtacttaagtacttgaaccaacagcttattacctttaaattgtaaataaacatctcaggatatatgaagcaatctaatctgcaggtggaaacaaaaatgttaacacattcaaataagtcagatgccttaaatggtaatttgtaagaacatagttgagacttcttcttgttaattgatttatctgttgatggagctgatcattactaatatgcctataagcatctagaaaactgtacggttctctctttgattcctataggcatatttctaatggaaaccagtaataaaattcttttctctaaagaatccattgaattgctctaattttttcttttgttcatgtttgaggactttttgagaaattttaactaattataaaacaaagtagagaagccatccaattaacaaatttcattgtagagcaatatttttgaaaagccaggcttttatttactctaaccctcaaagctctacagtacagaagtacctggaagaaagatacacagggaggtgtgggctaaattccaaatgctgtggggagttttccaatcttattaatgtgtaacaactaactggaatccaggagtgagttgcacaattgctatctagccccactagatcccccaaactgttaagtcattctctcctgtcttttcacacaaataatgtgatagtaatcactattatttatttagggtttgctgtgtgctaagggctgtgttaagaactgcatgtatattaactaatttaatctcaaacaaccatttgaaataggtgttattactgacactattttacaggtgagaaacatgaagcattgaaaaattagataccatgcccaaggatatagagttgataagttgaaggactcaaattcgaaccttaagattcagtttcaaagactggtttcttaaattctaccccaacagttacctccaaattgcatttgtatgcagctttgggactttcaaaaatcaatgaaatatttataaatgtattcatcccctaccccattcctcagaaatttctagaaacaatattgcatgtaaatcttaaaatagtcctgtgggatagatgttgttatttcttagcatagtcaagaacctgaatgatttagcaagttacctagtcaaaaagcaacagagtcagaactcaagtcctgactttctgaccccaagttcaaggtggctctgctgaactgcagcttcttcaagtcacctctatcaggagcacaaattcctgaccctgtgaagacagaccgattagggttgcagtctaggctacatgaattaccaattctggatcctcagctattaatttaaactcactaaacctcagttttcttatctgtaaaattgagattaaaaaaacaaacaacaacaaaaaaaacttaccccaggaaagttgctgtgaactttaaataagttgactttaaggctagggtattgtcacttacaaaaaaaagtaaaatttaatatataaatacatagaaggtgttcagtatccagcattcctgcaaaatgaaaatcaaataaagtcactctcctactgcaaaccctacttcccccattccataagatgcaaactcctctctagttccatgaggactttcgtggtctcatttttgtccaattctgtcctcatcccattgctttccggcccttactcactaaggtcagccacactggccttcttgaggatctagccttaaggcctttgcacatgcttttcttttccatagaatgctcttccctcagatcttcatctggtactttctgccaattgtttcccagcttgatggtcatctgttgagagaacctcctggataagccaaccattttctgctctatcaccttatgtatatcaccctacaatctcatcatttcctttctagcatatatcctaacctgtttattttatttgtgtttttattgattgcctctcctcaccaggatgttaatgccagccttgttcactgttgtatccccagctcatagaacagcatctggcatatagaaatggctcagtcaatatgtgttgaattcatggatgataaatggtcttacctaatttactatccttcacggagatgttaatcacaattggtgattgtgatcttagcttcttctagcaacttattgtggataaagtatatattttaatgctatatccattagggtatagttattattgcagagaacataatggaatttcaatgcatttacacatgtttgaacaggatgaaatatatgagtagtacttgcttctgtgtaatatgcaatattgctgaaagcatgataagtggcacgagagatggatgtcacgttgtttgtgatagtttcccctgtctcacttttaggctaccctccacagaaaaagccagtccacgcagggctctatgaaaagcccaggacagcaacccacccatgtggaaggtgtgtacaggccttcttttaatggccttatgtaggaagatgtaaagagtttgggcttttatgtcacatatctgtattggaaagccagccttaccacttaccaagttgcataaatttctgtgttcctcagttttctcatgtgtaaagtggggataataataccaaccatataggattgtcgagaggaaaaatgcaaaattagtacatagaatacacttacaaaagtgtaagtgctcaataaaccccaaaactacttttacatatcctccatgagagtcggatgggggtgggttcctgtttcctcttagggagagcagatataagaaaaaaaaaaaagtatgtgataactccaaattttgattatttagttttattgttaaaagtgaatcagggttgggaggccaaggcgggcggatcacgaggtcaggagatcgagaccatcctggctaagatggtgaaacaccgtctctactaaaaatacaaaaaaattagccgggcggggtggcgtgcgcctgtagtcccaggctactcgggaggctgaggcaggagaatagtgtgaacctgggaggcggagcttgcagtcagccgagatcacgccactgcactccagcctgggcaacagagagagagagactctgtctcaaaaaaaaaaaaaaaaaaaatcagggcaaatttcagtatttcacagtgttaggtcagtttttccttcttcaggtattagaggagaaccatattcacaagtattaaatggctccaaagagcaaggcggtatgagaagcagtagcgacaagacacccaattctagcatgggaaatgtcttgttatttttccagtagcttcacgtctctgaacttcaaaagtgctcatggaaagcaagacaatgtcctgctgtaccctcttcccctgggtcccagaattcaattaaaatcacgttctatcttgcctaatccaaagtgttttagatgaagggaacctggaaaacgggactatatctgtaaaagtgtgactgtattgtatccagcaaggttctatgcagatagagatgctggaaaacatccatttgatggtgaaagaaaatcagatagatagacagttaaataaatagctcctagagcttttcagcacattattccttcataactggagcctgcagggctactcatgaaataaaacaatcttgtaatcatgtaatttcaaattcattgcattgtcttttttgccaacattctttaaccgcgattccagcaaagaagatttcagcatattgctattcaaacatattcaaaacctatgacaagctaccctttaagaaggcattagcgtgagtgccatgggaaaatgtactccaaggttgtagatgaattgatatgatctccttgattgtatctttttatttatgaggcataatttctgagcactggaaagcaaactgcaatgagtgatgactaacaacaaccaaagtcataaatcagcagcagtgaaagaagtagtgattttgatcgaatctattgaattagctgttggccttagccaatacaggtattggaaagacctttttaatatctatttgtccccctcatgggaatgtgataacaatctcattacatgcccctaggaaacaaataatttaattgtttgcccgttaacatacaacctgtttacttattaattactggcatagctgttcatgctagattttttgtttatttctgatgtgaattgttacaaaattatgttcacattccttagtttttataaacaattatgtctccttagagcttcttgatataaatttgtcctcagaattgttgaaatgctttttttaatcaaatattgtcattatcccacaaggaagtatgttacagagtttcacagaagttgcagagagctcagatattcttccctctcttaatctctgacagttaacacttttactaatacaactcttgtaataagcagcctggataaagaacaaaaatctcaaattgctccaagcgtaaagacagtcatcatcacttacattaggagttaacagattagagatcttttgtaaaagattaatcggctgaatttggttactcctgtattacaattttatgaggagaataatagcaaatgtaagaccaaatagacatcagcttggtgctgacccatatacaaaccatccataaaccatatattatgaagtatgttcccttgatttgaacaagacttgtagcattgccttggccaaaagaatcataaaatattttcacaatttaggggtttttcttatgataccataaaggaaaaatgcatcaggaacccccttgaaatgtacattaataacttagctttgctgtaagacaatacttggaaaacatcagtcctaaggaaggttatttcagaaagatatgagacattgagcgaggcaaagcattaaggtgaaaactactttgtttagccaatacaggcattagaaagacctttttaatatctatttgtcccccttatgggaatgtgataacaatcttaacaagttaagtgtggaaattgtgctaaaaaataactagcacaggccgggcgcggtggcttacgcctataatcccagcactttgtgaggcggaggtgggcagatcactaggtcaggagtttgagaccagcctggacaacatggtgaaaccccatctctactaaactacaaaaaattagccaggtgtggtggcaggcacctgtagtcccagctactcaggaggctaaggcaggggaatcacttgaacccaggaggtggagatcgcagtgagtcgagatcgcgccactccattccagcgttggtgaaagagcgagactctgtctcaaagaaaaaaaaaaaaaaaaaaaaaaaagaataactagcacagtaacagaagcatccaaagggtcaccattcttggagatttctgatacatttccccttctcccatcctgtgcagactgatggtcccttctctttcccattcacaaaaattattacaatgcttctgttcacaaatgtttgcttttctcctagaataaaattaggaggagaaatgttgggttgagagaaattgggagcatttagaataatgttactctgcactgagagaaaaatagactcagcaatttctagaaatatcaaggtttcaagaaattactccttaagtgaaaattaggaggcaagaagtggttctacaaagtcagtaaactctagttctgtttggaactgtgaaaaaacacagtaattaactctatgatgattattgaattgtgacatattccaagatacatttattgtgtttatttgaatgactaaagttaatgtgaagtataactctaaagagacataacaaatagaaattgaaaatgtacagtgcctatattctgtacctggctctataaagaataggcctttgtatttttcaaataatattgggtgtaaaaagcgcttggaaatatgttgaaagggcagagtccaaggtcttctcaccagaaattctgatacaggtacccaaaatcattttgatgaccatggctaaggaatatattgtgacaaagacttctcttaaaagaagatttctaagaggcaattttcaagagagaacaaatgattaaattcattgttttcacagcaatgtgattatggcagcttagtggcagatgttgacactccatgtaattaaaaatttttaaggcaaaatacaataattagtcctttggggtaggaaagagtaaataaaagaacaatttcatttttttaatgaacaacaagcataaatatggtaatagtctctagttagatttaaaaatatattacattgaaaacagaaattccattgaaaactgacatattaatctatcattttgctagttaattacagaatttgtggctaaacaattttagtttttatgcttattaaaagtagttaatctatgttttctatgacattttacattgtaactttcttcatggttacaacagaaaccttagagaaataaatcaacaagtcagtcagtcctaacttttcattattaacgactagggaagtttctgactctacaatcataactgtgtgtgcacccactcattcacatgtgaaagtgttcaccaaacccaaataataatgtatttcagcagcaactttaatcatctttaatcttttattataaaagaataaatatgttcagtctatgagaacacatggacacagggaggggaacatcagacacagggaggggaacatcacacaccagggcctgtaagagggtggaggctgggggagggatagcattaggagacatacctaatgtaaatgatgagttcatgggtgcagcaaaccaacatggcacatgtatacctatgtaacaaacctgcacgttgttcacgtgtacactagaacttaaagtacaataataaaaaaatatatatatgttcagtctaaacactgtaggaacaaaaatatcctgaataaatcaaagatgaagaacatcttggcttttttttctcttggccatagaatttataagccttacttgcttttcttccccaataataactcttccatttttctaggagaagcccacacactaaagaaagagaaaatacacaactgtttgttcacaagatattttatttattgatttttatatgggttcattgcaactaaaagatcgggacatattgctaaaaagttttctatgtgggatctctgctgcttctttctctaccctataaagacagaatcgaatcttggggcattgtttctcagtgggaatcataagcataacctgttagtatttttaccctgaaccctgaactacacttcaatacttttatctcttgcttagccgggcatagacaaaaatccacagtgatattttagacaaagaacgtttttacctcagcagagacagagacaaagacagagagacagaaggagacagaaaaaatattattcacaggttcttttttccttttctcctagtggtttgatataacagagacactgcctcatcatacaagttttgtgaaattcataatgcttcattatctcagtcagctttctcttcattctgttttcattttcacagtagctcatgtaaataggttgatcctgctttgcataagcatgttgatttatatgaatgctattttgatctcaaattgattgaatactaaaaagaaagtctaggaaaaagagtaatgtattatgaaggactcctgccaaagacaaaatagcctgcatacattccctattagtgatggggaattttgaattgcctggttttcaaagagaatatttccaaggaaatatagcaaaacactataatactgaggcccaagtgtttttaaaatccagggattaaatcacattttggaactagaactccacctagtagaagttcacgtaacacaggaaggctgagatttagtacaatctacgacactaccattaaaaagccttaatagtatttatgattctatatctacattgaaaatgaaagaaaagttaatgttcataagccagagccagaactgtgctgagcacttgctatgaattatgcttatttcatctcattttctttcaacaccctatgcctgcactacttccatctcctattggtgcacagtaattaattggcaagttgttgaatttttcttttattatacctagttgcactttcttcctcattttcctccccatccattgtagcctgaatttaaattctgcctgcgctcaaatcaccaaccaaagttctgctcttggcaaaaaacgtcatatcaatatttgcaccttactttgcattcctttgtcaagaatattgttttaaatcttgtcattcattgtgtaataataggtgtcccccccaccacttcccagaaagatatttgcagtaaaagaggttgttctggggcacagtgaggagacaggaaccctcctcatcagccctgaagtctgacttcttcatgaataacctccacctcccctccctagtgtaagtctgacctcacctatttctgaggggactctgagagcagctgcagttgtattctgatggatggactctaacttccatgaaatctggctctcccattgctagctccttacttccctgtgcttaccaaaacaaacctccctcacctaagacaacttgtacatgtctatccatccttgcaagctaagacaccttaacctaatctagaattgcaggtattcgtctatggacaagtcgtttaattttcatgattctgactattttatttatgcatatggatggcatacagaatcaaaaaccctgctcattgaaacaggcactggagagcagaattcttgtttcagcacttgtaacttttgtcaccttgaacaagatagtgaaattttctgaggctcaatttcctcacctttaaaaggggactagtaatacattctcggctcaccttacaaggtttccattggaaggactaaataagctgacataagttaaagtgctttgtgaaatgtagagtttatacaaatgtgagtgattattatgcaaatgatgagaggatgtatccgagctctaaaaagagcaggtgtatctatgtaagtaggttagttgtctcttttaaaaaatgaggctcctggcaatcctatcagcaaggggctggagatttgcatttgacagcaacctgaaaacaattcaacatcagaaaatttactttcacaaaggaatccggaaaaaaagaaaagtatgaaaaccactgataggagttgacctaactactaaaaatctgtctaatgtttcttctcttgaagatattattgatgcaaaagcaaagtaaacaaaaatgaaactaaactctcactgcaaaatattctcataggttttttctttttttcccccacaaatatctcctattttgaacattctgcatgctttttttttttttcaatactgcatgcctggaatgtgtgtactgtagaatcaaacaagtttttcagatttgtctttaaaagctcgggggcaaatttttagaaaatatataatgtagaagaaacacaatgagaaaaaaatttcctgaagttaggctttcacatgaaagcttactaaggaatactactactcctaaacacgcagacagtcttcttgtattgccatttagatctatcattctgattgatcactgtgtagttggctattattgggcctaatttaaccctatacactcacacatccatctactctgtctattgtacctgacattctacaaattacttactcatgcaaatgacgacctaaggcaaccttttaggatattcgtgtttaattatacaaatggttcttgataaataagattatacatcgttccatatgtttattccctccttgatgaaaggaaatttaattttcatgcagatttggtggggacaatgtttaagaattgctgagttttttgtagtctgcagatccatccagtctgcagaagctgacaaaatcactccacttcccacacagagatgagcagttttttcattaggcttaaatcaacgtgctgcattctgaaatcctaaacggccccctttgtgttcacatggtcaaaggcaaaaggcaaaaaataaaaataaaaaaggaacagcctgctctccttgctctcctgtgtgattacaaggttgcaagatcaaagtttatctcttcctgttgtgtttagttgcttttggttgccaatttcgttttttttcctttcttttttttttttttttcccagccttagggtatcttgcttttgacagtcttgttgatttctctttggaggtctgggcagtgaattctgcaggaaaagcccccagtagctggacatggtgcagaaccgggccagccccaccagaaggtctcagagcccccacgttccatgtgatctcttctacccaagcagtggtcaacatcagtgcccctgggaagcccaacgggatcgtcagtctctacaggctgttctccagcagcgcccatggggctgagacagtggtgagcagcagagctaaaaatccaggactggttgacttttaaaaatcattactatgaaacctttgtttttatgtttttgtttttccctccatctttcttatccttctgttctcagttgctctacggtgaacttagtagcacaaatatccctcagagaagaaaaagtgaaccctgaggaaacatacagaaagtatgtaaactcttagggagagggatgctaaaggtggtattaaagactccacaaacgtaagaaactaagactttaaaggcaatcacactaatttaatttaatttaatttaattagaaaacagatcaaccacttagagtggtggcacatagtaagaagttggcaaatggtaattattggtggtgtaaatgttagtatgaaaacaaaatagagcaaagaatatccttggaatctctattttgacatgcacaaatctctaataatacatggaaaactctcattcctctggtgatttcaagaaagttctaaccctttagaagagagagcagagcagctccatcagcatagccctagctccactgtttgttcgttaacacgtttgaggcacactgggagacaggagagattgctcagggaaatcatctttcacattgtgcgttagccaagccacttcccggaagcgatgctaagaatcaactagaccagttcctgcattatttaaatgaagataccagcagccagcacgatgaagactcttgtctctgtggtatagcttgtgtcactctcaagtttctcatgaataagtggagattataatactttgttcacacaaacattgtatagagattgtgcagatcctggtattacactatgcattatttaggccaatttagggaacaatttgggcaagtgtggagaattcctctgagaccagagtgtcaggtattgaaacacaatttcaacagataacttacatacagggaggcttggattgaatgttaaaggaatattagcatattttctatagggcttcgtactcaataaatatagatgatgtaaatacaatcaacccttgattatccatgcttataaaatgataataaactaaaataatttatatttggagggcattgtatgcattttttaacagctcttcttaatcatatgttctttatgtcaacatgaacattaatttcagtttctgaactcttgttccgaagagtacttattaaaaccacaatgaggttaaaaatttgctcaaaataaaccaaaactttataatcctacaaagatgattgagagaagactatgatattttgtaaaaaccaacaccctcagaggaagagatagactttcaagccctccaatacttatacctgattttaatgtagatctgaaaagattttttgactgagaaattgcatgcaagtaaccatggcagaatatggaccttggtgaatgctgactagacatataattggaaggcagattttgttttttgaaaagacatcactctgagggtcatagactttgatcaacactttgtgtgttccgtgccattttctaatacctttctaaggtaatagataatcgataatattatgccttgtgatttccatcctgctacctcaaacgtctatttaacggttacattatcagatttttcacctatttgtcatacctctctaactgagttggtaattttttgaggataaatgtcatgctaaatgccatgttgtgtctcccagagtgcctggcatggtactccatttgtaggaggtgggatcttggataacattcatcaaacacctttaatgtttgacactgcctttatctagccttccttccttccacagctatccgaaggcatggccacccagcagactctccatggccttcaagccttcactaactactctattggagtagaggcctgcacctgcttcaactgttgcagcaaaggaccgacagctgaactgagaacccatcctgccccaccctcaggactgtcctctccacaaatcgggacgctggcctcaaggacggcctccttccggtggagtccccccatgttccccaatggtgtcattcacaggtaatgggtcaggcagaaggatgaagaaactaacaaggcatgtgtacagacatatgaactcatggtatagcctactctgcacctaggctacaaacctgtatagctacctggcactccccagggaggacttgcttattgaacagatatctatagcaaagtagacaaacaaattgatttgagtggtaatgttacctgcgatgtatttaaatcataaaagcaactaatgatagaaaggagaacaacgaaatgttttacattaaaaagacaatgcaatgtgttcgtattcaatatgctcttcctaatggttatctggaagcattccttctaccagccttcactggaacataagatacctccacagttaaatcagaattgccctgatctaatttaaaatattgtcataaaccactgtttgaaaggaaaaagaagacacttgactcaaaatcatttagaaaaaaaattatttactctaaaaagagaagaaccatttatgtctctcctcttaaaagagggaaatgtcttatctctaccaaaaaggatcactagttgctgggtaaacagcaatgtgtgtgtagatggtgacttctcttatcatttctctggttacatctgctgctcgtttccaatagcattacataaggtgtttctgagagcagtttcctgcaaatggaaattttaaagagcctgtagctctgtgaaaacaaaatgtctcctcacaaaatagaactggttttaaaagagagagttaaactaattccattacccgtcttgactctacgtatccattctcattttagctatgaactccaattccacgtggcttgccctcctgactcagccctcccctgtactcccagccaaatagaaacaaagtacacggggctggggcagaaagccagccttgggggtctccagccctacaccacatacaagctgagagtggtggcacacaacgaggtgggcagtacggcttccgagtggatcagtttcaccacccaaaaagaatgtgagtataagtggctgctaccataagccagagagattggaatgtggtcaggagaagcttgccctgaaactcggagaagccacttttaaaaacagattgagtgggctcaataacactgaatgttactgaagcattgatgaggatgactactgaggaaaaatgcctactggatttaataatatggaagtcaagggaaaatttaagaaggattttcttgtggggatagggtaaaaataaatttaggggaagttaaacgatcaatgggaagaaagaaaatgaacaaacactggtagaccatttttataagaagttttgctactccttttctttgtaaattacatggcataatctctagtatgtccagagagcattgagacatagcactattaggaaaagcaaaagggcaagtgagtgaaggaaagagcaatcaactaattaattgggggcttccttacatttttatataatacagtcacgcatcgcttaacgatggaaatatgttctgagaaatgcatcgttaggcgagtgtcgtgaaaatatcatagaatgtacttgcacagacctacatgttataacctactctgccccataggcatgtgactgtgctgaatactgcaggcaattgtaacacaatggttatttgtgtatctaaacatagaaaaggcacagaaaaaatctgatataaaagataagagggccaggcacagtggctcacgcctgtaatcccagcactttgggaggccaaggcgggtgaatcacctcaggtcaggagttcgagaccagcctgaccaacatggtgaaaccccatctctactaaaaatacaaaaattagccaggcatggtgacacatacctgtaatcccagctactcaggaggcttaagcaggagaatcactttaacccaggaggcagaggttgtagtgagccgagatcacgccactgtactccagcctgggcaacagagcaagactccttctcaaaaaaaaacaaaaaatgtaagagatggtacagggcagctccattataatcttatggaaccaccatcatttctgcagtcttgctcaaaatgtcattatgagatatatgactataacttagattttataaggtatatgctttcattgtttaataatggcaaacacaaaaagtattaagaataataagtgcttatcagaaccaactgcataatttatggagtccagtggaaaatgaaaatatggaatcctttgctgaaaaatctttaagaattccaagacagtaacagtacagcatcaggctaagtccaagactcttctatgtcacaggcccttgcaacagcacaggtcacatgccaaggaagctggtccagcttattataccccaacccagaggcaaccactactaatattttggcataatcaattcttttaatctcctttctatgggtaatttttactatatggctgaaatactataactaaaatttcatagtcagctttttatacttgacgttattgtatttgcatttcccgtggcattaaaaaaactctttagccaccaattttaatggctatacaatattccatatataaattaattgggacattttgttttttttttaatttcccattaataaatatgatgaaaaaatctttgtgaacagatctttgaatgtctggttatcttcttaaattaaattttgacaaatagaatttgctattaatacatcaagtattttaatattttaaggctttggatactagtttcatgtttgctttcaagaaagattatgtcagattataaatcttacctaaaatactctatctggcattgaatatgatgccaattttaaaagcaagaattacgcattcataaagaccaatgtctcacacaaggagcttaatgtgtctgagcaacaacatggtaggatgttagtaacagatcacatttacagaggacttgtttgttcctggcagtattttagcattttacaaataattcttacaacagacctattattatccaaatttacagatgaaaaaactgaggcagaactataaactgtgtactgcgattccaggatgccattcatatagactatgatctgaactgaggctcttggagttagacagtgacgtggccctaaactaaggccagagcttaagtaacctggccagtttccacatctagtaagtgcagtaattactctgaactcatggtcactgagctcagctgctgtctcagtactactctttccctgatcaattcatttcctactctctgtaatcaagacttcaaaccatctccaccttcgccaaacctccctctgccgctcaccctttctcccttcatgcccacaacccagctcacccatttctccctttattctctgcagaactccttgtcttgtaattttccaggaaaagagatgtcttcagtcagtaatttgctccacttcccactgcagacaaagctacctgcatataccccattgctgtcagtgacaaggaaagggtggtccttcttccgtctgaaataaacctgccttccatgcagtgaacttcatccacttcattactcaccatcccttctctctccttaatctttctgtgtatctcactttgattcaaagttccttctacccttctaatgttaaagcaaacaagctcctcttcccctgcagtgatgtggactctactctctctgacagcaaaactttcctgaggaacggtctgcagatgctttgcccatatcctctcttccacttactctttaacttcctcagcactggatgaaaatccctttctaagtttgcctttggcctccatactgatatatccagaaggcatgtttctccaggagtcaccttcactgactttccagtagcattcaacgcaactgaactttcaatgttcaatccttttttaaaaagtggtttaccctcattttcattaccaccctctcctggtttctcctctacttctttggattttcatttttagtcaactttgttggttgatcttcttccgctgcccaaatcttaatcctaaacattttaactttgtccccttgccgtttctctactccctcctttcctcctccctcatcaggtgagttcatctgctccaaggctttggttccaaaagccaaactccagtggtcacctcctagtcaagtgctctgttttgaagtgtatacccctccacccagattcctcacagacatctccctctgaatttctcataaccagcttacattggacaggccccagacagagcttgcaactttccccttcaagctatgcttcctttagtcctcactttctccattttcatctccagcactgggcacagtatcttagattccaatcaatgttgtttaatgaataagcgagtgcacctaacactgcatgtttattgttgacactgctcaatcagcattttttgtcacccatactatattcaaagcaaactgtaatgattcttaatgtgtgctgtctgattttgtaatctcctttgcactacatccagaagccaattttgctaaatgttgcagttttttggttgatgtggccagaaagccagagaacagctaggtgagctttgtaatttataaccaattcccttttgagtcatgaagcttagcttttgccagaattttttttttcttatgcttggaagaacaaagtgaactgatttaagattttcttcctgtggccaggcacactggctcacacttgtaatcccagcgctttgggaagccaatgggggaggattgcttgaggctaagagttcacgaccagcctgggcaacatatcaagacacctatctctacaaaaattttttttttaaatagccaggtatggtgacatgcgcctgtagtcccagctactcagaagactgaggcaggaggattgcttgagtcctggaagtcaaggctgcagtgagctgtgatcatgtcactgcactccaaccttggcaacagagcaagacttggtctttaagaaaaaaaaaaaaaggattttatctatttgtgtttttttatattggagaagcagcttaaacctggactagcaccataggagaagaggttcccttaatccactactgggtcaatagttacggaaaaatacaagaaatgactatgatacaggttctaaaataccacttatgctacttttaactcattataaatactgggagcacgaaaacatgcaccagagaatacaaaccagaaaataatttggggcctggtgtggtgtctcacgcctgtaatctcagcactttgggaggcagaggtgggcagatcacttgacgtcaggagtttgagacgagcctggccagcatggtgaaaccccatctctactaaaaatccaaaaaaattagctgagtgtggtggcacacacctgtaatctcagctacttgggaggccgagtagtgagaatcacttgaacctgggaggcggaggttgcagtgagccgagatagcgccactgcactctagcctgggcaacagagcaagagtccaactcaaaatagtaaccataataatttaaaaatagaatatgcagttttatatagatgtgatcacatgtacactcagcaacgggtctggagaagaagcctaacaacacatttagttccctctgcttgaatcccccttcagtggagagagaggtgaggtgtaaatgtttaacagctggcctgcttgagggaaaaatggcctgatttgaagtgcttatcagtttccatggtgtgaatacccccattactgctctcaagtgaccaacatgacagcactgaacagagttaggaagggatgggttgtagcgtatcattatataatatttccaccagccagatagagtggatgtaaatgacctcgagcacacagacggtagtaaaatgtagtgaaacaaataaaaagttatgaatttggagtatttataagctttgttttaatataatttatttaagtttatataatttaatttttagtagtggccggatttaacaatgactcacaaaattcctgaatatttaacagttggggtgagccaacttcagcacaccactggagagcacccatagggtgaattggtaaattctgttcttttcaacaaatgtgtaccgatgataacaaagtagcatgggccttatttaagcaagcctaggttcagctccttggtctcctaccagccactgacatagagcaagatatttgacctctctgaacctgagttttctcaccccaaaaattaggaatcaatctttacaggattattttgaggattaaatgagataaagtatgtcaaaagctaggagcgtagtggtacttacagctttttcagtcttccttggggaggatttgtaaactcattattctcgattattttaattgcttactctttttcctcaggaaggtctccaaaccctacaggacaaataagactcctatctttctattttcttgctagttacaagctgtttctttatctgtgctgttatgatatagggaaaaagtgaaaatctactgaactaaggtgatggagagaagtcatagacaaataacaatagagtattccttgtgatatcaggcagaatcaatgttggaaaagcattgagatttaaagagggcttgataactcttgttttggtgtttgcagaaaatttttcttatggctttatgaaaatatcttattttgaaagataacaatcaactgtgtctttacggttgaatattacaattacaaaagcataattattccttattttgttatatttcctaacatcagaaatagatggattgatttttaaagaaaaagaatcagattcaatttagtctcactactcactcctttcttttcttaaaagccaatttggtatataggtgaatcttaatgtttttacaaatatattgattattttgtagaaaataagatctcatgaaataaatctcttctgacttgacaagatgacatggtatcccttcatttgtttccacaaaaattattcatttaaaaggtgagccccagttaaggattttctttttgttttagtaaggaactgaaaaatcaagagaatgtgcctgtgaaatgcacacaaagttgcttctatatgtgatataatacttaggacacctgagcttgattatatactaatgtactatgctattgattgattagtcagggccatgaattattatacttgaattactgtttgcaaggctttttaactatcttagaaaacaaactaacagtttgagaaaaagctttaacaataaatgggtgccaaaaggacgtaattcaccatctaagcagtttggtttggagaaaaaaatatattaacttcatctagtccttggggctttgtggcaataaatattgatttgatatgaaaaatagctatctactgtacttaatagtattaaggatactttacctgttaaaaagagggaaaatgcaacaaaatatgagctccagggttatgctggtgagcagatccattgtatgttaatagttttatttataaaacaccactctctatcgattttttttaaagcaggcataaagttgctgagaaagcatttcacacatgttcccattggttttcttttcacccctgatactggttgtttcgtaatactgaggaaaaagtgaaggattctagcaatgttggttttcttttttttttttttttttgtttggattggttcggtttgattttgctcatattttttttttttaaagtgcacacctgcactccttcaaagaggttaccctttttagaacatacaactttctccccacagtgcctcagtaccgagccccattttcggtggacagcaatttgtctgtggtgtgtgtgaactggagtgacaccttcctcctgaacggccaactgaaggagtacgtgttaaccgacggagggcgacgcgtgtacagcggcttggacaccaccctctacataccgagaacggcggacaaaagttagtttctgactcctgtttctcagtgtggaaggcgctctgttccccagctttacgggatgctaaatctgaaagctgaccagcagatgctcaccattaaaatgtcttggtttaagtgcccccttcttgtgaaaaagttactgctcaggataaataaggttttctttccttcccatttgcagcttgacagcactgcagttataatgcagttcaaggggacagcgctgcctccacaggactggagggtccccaggaagggataagacccaagggccagttgggttcacaaaagaaatagcacccatacatagtcaatgactaccctaaaataatacacttctagcaacttcatagattttcttgctgtatctccagtctccaaacagagccctatcaggaaataactatctccaactcatgaggacctgaataaggggtttccttaaccttccttgatatcagcccctgaaagaacaatcttgaccctctaaaatggagttccttcttcctgtttacttacatgtcccttttctccttgccttgtttttaaattgaaatgagaaaatgctttacaaggtgctaagtattttatagtgatcagcatgctcacaggaccaatgttcactatataatgaattgattaatgagtattttattttggctgtaaggtagaggtaaacagtgagctccagcattgcatgtatagtaatagaaacttaataacatttttacaaagattcagctacacatgttcattgttacagttcatggtcacctgggcagctctttgggaaaggaaggtggcctgatggttgggagacacaggttctacctggccaggcctataaccatctgtgtgaccttgcaagggtcacttccctcaggttcctggccattggaagagcaatttagaccatgtgatttctaggatcccttttgagctctcctgttcagtaagaaactctaggtcatttagtggaaagtacacctgtaaattttaaaggaaggatttaaaccgtgtgcagaacaagatgcgctttgtgtattaccctttactcgtctgatgttcttttcctttgctgtataagctctaattttccttagctctattacttatggataggctattattacactaatgatagctttttttcttaaacattttaaaattagaagtaattttgaatattatataaaacgtcataacttgctttggaatcctatttttcatgctatgatgcattgctcttttaaaagcatgtgccctatttgtaggtgttgaatgaacaagtcatttaccagttcttccttttgtctagccttctttttccaggtcatctgcacgactgacgaaggaagtgttaagacgccgttgatccaatatgatacctctactggacttggtaaacaactcatattatacttggcgtagcacctattcatcttcctcaagaaacacacatatgtttgtttatacatacttggagtcctaatatattagcatagactatacagaagaaattgtgccaagtgttgtcagagtttttttttttgttttttttttgttgttgtttttttttgagacggagtcttgctctgtcactcaggctggagtgcagtggtgcaatcttggctcactgaaacctccacctcctgggttcaagcgattctcctgcctcagcctcccgagtagctgggattacaggcacgggccaccacacctggctaactttttgtatttttagtagagacatggtttcaccttgttagccaggctggtctggatctcctgacctcgtgatctgcctgccttggcctcccaaagtgctaggattacaggcatgagccactgtgcccagccagaaattttttaaaaagtcctcatggaacttatatcaggcaaggagttacaatacactctttttttttttttttttttgagacagagtcttactctgttgcccaggctggagtgcagtggtgcaatctcagctcactgcagcctctagctccaggttcaagcgattctcctgcctcagcctcctgagtagctgggactacaagtgtatgtcaccacgcctggctgattcttgtatttacagtagagatggggtttcactttgttggccagggaggtctcgaactcctgaccacaggtgatccacccaccttggcctcccaaagtgttggaattacaggcgtgagccactgcacctggccagaatgtactcttaaaatgccaaatattgaattgtaaatatggaaaagaccagagagctcaaactaaatttttctcctaaccacaaaccctgtcaataaagaattgtatgacttcgcgtgcataaaggtgatttacagaggaagttagaggagagatcagaagaagaaagaaaatattcagccaattcatgttgatcataatgttaatattctagattcaaagcctagaatgataaatttggaaagtgtcttttattctccataaaagattatgattgactgttgatatcgggtaatttagctcaacgggtacaattttaatttttaaggagcatcttttaaactgagttttactcatagtctctgaatctaaatttgtgatactttataaaagcaaattagagaaatgccaaatcttttccactaaaacagattcgggattgatatcctattttaaattccagtaattaatgatatatcaaatttgcatgtatagagtttttttttgaaaaataaacatgtccaaaatttctgaaacacaatttaaaaaaaaaattttttttaatttttttgagacagagtctcatacatgatgaaacatgtatattattgtcaaggatagtttcaatttgtaaaaataacgtattattctatgtttccaaactttacatgtctggatgtcatataaaatttcctacaacacttaattcttctcatacggcttatttcatttaatagcagtggtaggatagaacagatctcatttagtattctgttagcaactccaatatttccccaagtggacaagtggaggtataagggacacaggaatttatccaggaatgctctgctagcttgttactgggatgagaacaccaacacagattttctattgacttctggcctgggactttttctttgcaatggtttgccaagttaagtacgcataggaatcacctcatgtgcttgtttattgtagtttcccgggcctctggcagagattcagactcaaggaggctcagaatctgctctttaaataagtcctgtccagtgattctgacacagggctcagaaccacgtgttgagtgatgccggaaaaccaaggttgctcgccttctaagccctgccagtctagtttccttggtgaatgggaagtgtgttgttcctggaggcaggccatcaacagagacggatttactctgacactggctgtggtttcggttttctttggatctgaggcccagccaccagagtttcaaaccctgacagtgaacctcccatgtgatgcacaggtagagtcccttaaggtgaaggggtacttcaaaaagacagaagggaagggataaagggacaccatcctgatctcgaggtcttcataaaaaggagaaatcccccgttggctcatgaatacgaattgaggtttccactgtgtctggaggccgggctttgggtagagcagaggggaagaactctgaggattgtgcaatgctctggcagattccaagatgtgctgcccaactaatatccatcgtcagttctaattttcatgatgtaacttttttaaaaacattcctgttcccttgcctgaaggcagcctccaagcaggagagtggcagagacctcattttcctctgactgttctaagggctatttcccttttgaggcttccctcgggcaggctgccctcccttcccctgcgtgctgtggagcaaggggcccactgggcccatcagatcagtttctggagttacagccaacaagttgttttctctctgtgccacacacagaggaaacaactcttttagtgtgcaacctaggctggtttgtttttaatcaaacaacacacattggttcctaattaggggaatttcgacctgctggagcttgattggagtgttgactcaaccctttattttagagatgagaagcaaaggtcagagtccaacatttaatcacagagctgatcggcagcagagttagggttggcaaagtaatatccctcctcttacggagttcaaagtttagttttagtcaccatctgttcctgcctttaatagtttcaccccagttctgaacttttttcctttaagtctttccctgctagtgtgagtgtgaagtaccacgcaggcccatggagttctagaggtgttgaaaagggggagatttgtccagtgagtgagtgggctttgcagttgtgtctgcttgttcttctgacctggctgtgggtattagatttagatgagcagctctctggctcacatctccacaccagcctgtgtggccgctgcatcagatccacaggtttctgtgctggccccagcagtggctggatgggagcagatctctggccaccccacccccacccctgccgcacccctgcttagcttgccaagctgacaacataatttcactgccttcgcctatcctgcatgattcttgtcagcctctctcctatcttccccacaagacttaataaacctgcctggctgggtgcggcggctcatgcctgtaatcccagcatgttggaaggccgaggcaggcggatcatgaggtcgtgagattgagaccatcctggccaacatggtgaaaccccatctctactaaaaatacaaaaattagccaggcatagtggcgcacacctgtaatcccagctacttgggaggctgaggcaggagaatcacttgaacccaagaggcagaggttgcagtgagcggagatcacaccactgcactccaacctgggtgacagagcaagactccatctcaaaaaataaataaataaataaataaataaataaataaataaaaataatcctacccacccttcatccctgtaaagctctaagcataggacctggcaccaggtacattcttgttaaatgtgagctacttttattaatactaacttcatgtgcagagactcacaccaactgaactctcaatgtgtgaacgccaagcaaaggtaagtggctccagtgctaaaagatttctttccataggaagctttcccagtgcatttgggtgatggtttgctgagctttgctctttaacagagaggccatgtaaagacaacatggtagcaaacacaggctgttaatatcataatggaaaatggaatctgatgcttcaaaatccagtttgcacgaagtatcaggaattggactgttgcatgaagcaagtacacctcagatctccaaggagtgattttgtttgtgactctgcagcaataatagtaagggtcccagtccctcatgagaatccaagcaaggactttgctcccaagacacacagctatgaaacaggtgaccctcaaggttactttggtaacctcttttaaaaattgctccccacactcccatctttcccagggatttgtcaagacagtggtgatttccaacctgagcagcagcgccagaagtgtcagcaaggcctctcaagggctgtaagcatctcgttataacccagcaacctgctgaaccattaccccaggctgcacacaagtgcaaacaagcagtaagagacaaactgctttctgctttcaactcctctctaatttactatcaaatagcagggccagagatgacaaaaatgctttctgaaataacatttcccctttctttctctgggttttgcaggcttggtcctaacaactcctgggaaaaagaagggatcgcggagcaaaagcacagagttctacagcgagctgtggttcatagtgttaatggcgatgctgggcttgatcttgttggccatttttctgtccctgatactacaaagaaaaatccacaaagagccatatatcagagaaagacctcccttggtacctcttcagaagaggatgtctccattgaatgtttacccaccgggggaaaaccatatggtatgtttgtagaggtgtggccccatttccctatcactggactagaatacttgttttccttctgagaaaaatgtgtcatagccatggtaacaaggaattagatgtaagttatgtttcactaagtgtggggaccaagagaggctaaccctagaacagctttctcaactttggctgcacattagaatcacctggaaagctttaaaaaatatcactgcctggacttcatccgagaaattctcatatccttggtcttgagtagggcctgaagattggtattcttttcttcactccaaaactgattttaatgtgtaactagggatgagtatctctgccctgtaattgtaagccagggcctggtggagaagagttgtatgttgagattacctggggaaattataggttgtattactgtgtaatttggtggcggggaatgaacattaaaaggcggagatggggaggaaggggctacagtgctagtggtgctcggtctgtcctctggtcctgacaccctgtgccacagaggatggatggctcctcttagctatagaccactcactcccaaaataggaggtccagtaaaggtctagtgggagagggccccatcacttggtattacaggacagtcattgcccagagcactcattgaagggtaaaaggtgatttaattccatggtgcagtctggtgtggggctatgtctacctggaggaggaaaggctgcgttttctaatcctcatcaggtacccatctgttcaccaaagctgggcgcccacagggctacgtctccctgaggaggtgccttttttccagtttgcactaaggttctatattagctagtggctaccctaggcagtactaaaattaagcacagaagcctggtcaagctgcttacacttcaacatttaaaaaaacagcagtgagtgaacacagcagcaccatctgccttccagatctcttcacttttccagcactcagcaatgaatgaccactggttaagccccaacatagctggatcagacctaagtagcaggagtgttgggagcacaaaagggcagtgggccctccgaggtccacggtttgtggtttttgtgggaagtagcaatgggacaatgacgtggtggtggagaagcaaagaaggcactgcccaacaccatcagggccttggctctctactcacatctgtcccactcctctactcactcatcctcctcggagcctccttcctccctgagcccatcagacaagctctaaccacagggccattactgctgctgctccttgggtggctcacactcttgcttcattcacatctctgcacaaatgtcacctcccattctatgtaaaatttcctagccccttaacccacttcttttcttttctatagcatttaccacataacactaagtcagatatgtttgtctgactcctgaaatagaaggtaagctcccaggatcaatgatcttgtgggcctcttcctgttgtatgtgccccgggacccagaacggtgcctggcatatcataggcactccacgaatgtttgttgaatgaatgaatgtcgagtgatcacttcgaaccatgggctgtttgctcctgttcagtgaatagtcattaggagattctcactgaagagcagatatttcaaaatttttccttgttaaagaataactttctttaaggagcccatgttcctagaaggtgcactgctgctggaggaaggcagtggaagagagaaaagaaggcaggagagatctgtttagcctgggagatgagctaaactgaaactagggtctatggagtgcatggagtggtgaaagggaggttcccaagcactgctaggcacatctactgtataatgtgaggtgcggttacaggaaagtgtacccacataccagcaatgtccagaagtcatttcagtgatactttctcctgtcctttgacccagtccctataggcaggcacctctgtgtcagaatcctccatgaggaagaacactgtcttccttacttggttaacttagtgaccagaagacactcccatcattcttgtggagatgttatgttactctggatataaccccattgctcagggttttaatgagtcttgttaagcttcgttttgtcaaagtgaggaccatgaactatctgcatcagcatcacataggaggagcaggacctgaagttctgagggagaaactcaataatctgccattttaaccagaacctcaagaagtctgggccaggctcggtggctcacacctgtaatcccagcactttgggaggttgaggcaggagaatggtgtgaacccaggaggcagagcttgcagtgaaccgagatcacgccactgtactccagcctggacaacagagcgagactccgtcacaaaacaaaacaaaacaaaacaaaacaaaaaaagaagtctgatgcacagcaagatttgagaacagctgaaaatgaaataataatataatacaaaacctgtatgcagtgtactgtttgataaccagtagaaacaggtggtgggagggtgctggttagaccttgctgtcctgacaccacacaggctaagccgcctctggggacagacttaggcttcagctgagaaaagcggacaaaagaatgtaaacaccctgttcctgcacaccctttaccatcggggaaatgcacagtggcacccaactgattctttcactgagtggccaagactgagtcaggtgtgaggatgggaaggcatagagggactggctggctgccaggggctctgggcccagggaactggctcatcctcagcagggaagccattcattgcaggcaggtctcagcagaagtgaaatctgggatacaccagggcaccgggtggaattcccctgagcctgttgaatcataatttaatcctatccagttgacagtgtatttgcaagtcttcttctgttgctttttacaaatatttttaaaccaaactgctctcacaaagttggagaccatgagagacattgtcaaaaattagccaaactaaagagagtacaatttgtattagtagagcaaaatgaagtccctgttggtgactgtgggctcctcatctactcaggtgggaaagaatccagtcaaggggaagaatctgaataggaacaagccagattcacctgctcagttttccagattgactgtcttttcacttgagtaggtcaatgagctatgcccctgcaacacccacccacacacacacacacacacacttctccccctcatgtgacaagctctggtttcagtgctgctgtgaccctcttccaagcacccgtcttgtgaacaggtaagataccctttgaacatcagacccaaactggcaaaaggattttaggctatactctgaatggagagaaataggcagaggtgccaaggaatgagagtgtcttttgtatttcatcaacatttttcaagaccatacagtatacagtatagctaagtttaagttttgcttgttatttaattactggtttgaagatcctttcattccctgcaatactaaacaaatactggcagtggtacttaccttagacactaatcaattaatttccactcaccaaggtttttttttttttaatttgtttgtttttgagacagagtcttctgtcatccagactggagtgcagtggcatgatctcgactcactgcaacctccagctcctgggttcaagcgattctcctgcctcagcctcctgagtaactgggactacaggcgcccgccaccatgcctggctaatttttgtatttttagtagagacggggtttcaccatgttggccaggttggtctcgaactcctgacctcaaatgatccacccgtcttggcctcccaaattgctgggattacaggcatgagccaccgcacccggcctcactatgaagttttagttgcaaaacccaactttctctctctcatatatatatatatatatatatatatatatatatatatatatatacacacacacatacacatacatatatattcacatatatatgtatatatacacacacacatatatatacacacacatatatacatatgcaggtatgtatcctaggatatatatgtacatcagagcagtattaaatatgggtatgataatgctgtcattggagaaatgcaaggaatgtgtttaaaactgttccaaacatggactgatgctgccatttgttctcagtttgactctgtggctgatatatctgatgtgtcaagcaatgtcaccctaaaaagttacaccatgcactttgaggtacctctgtgtgctgcatgaatgcatgatcttttgcatggtgtgttgactgcacagtgaaaagcaggaacagatcattgatgacttccatatatccattccttggaaagctgaacaacatgagtgaaaactctactgaaaaaagaaaagaaatgggaggccgaggcgggcggatcacaaggtcaggagatcgagaccatcctggctaacacggtgaaaccccgtctctactaaaaataccaaaaattagccgggcatggtggcgggcgcctgtagtcccagctactcgggaggctgaggcaggagaatggcgtgaacccgggaggcggagcttgcagtgagccgagattgcaccactgcactccagcctgggcgaaagagcaaaactctgtctcaaaaaaaaaaaaaaaaaaaagaaaagaaaagaaaaagcagaaacatttcattgattggaccagctaaatcagagccctcagatatttagagcaactatagtttatcttacggcgcgttctaggtctaaattatgtagtgactttttctctctgatgttaatatcagacctgatgtaatttggaggctggaatcctataagaaatggaggaatatggaatgagaaatgagggagggaggagtcaatttccctacacaaatccaggacttttaaagtgaaagacaaacggagctcacatagtggaccaccatgaaataatattgttatctttggctgttctgggggaggagtgttctcaagagggaggctctgtgctgacatgtatgaagaagataccttgttcacccatcatccgtctgccttgccccaccactttgcaatgcagcaagcccttgccccacagggaacaacagccagagcaccagtgcatgagctctctaggtgccgaaaacactggccacctaacttgagtattagctcatcatctcatccttcttaccaagaaacccagggtcaccgtgttgtgggtgctcatagctgctaaattctgtaggtgacagttgttcccttcattgacaatgtgacaattgtcaggagacagtcattcccttcactgacaatgtgtgagacacaattctctgtcatatttcaagcccatattctttatatgtgaaatactcacagcaacttccttctcaggggttagccgataccaaaattccccggtctgggacacctgtgagtatccgcagcaaccggagtgcatgtgtcctgcgcatcccgagtcaaaaccaaaccagcctaacctactcccagggttctcttcaccgcagcgtcagccagctcatggacattcaagacaagaaagtcttgatggacaactcactgtgggaagccatcatgggccacaacagtggactggtgagttggtttcctcatacagggcctttgctaaatatcccagaaaaaatattggtacagagctgcctgtacttcaccgaatgctgccccatggcactcgcctctgagcacttagccagtgaggtagtaacaaccggtttactaatgttacttcagttgtttgataagcagggtagaaactttgtcttgttcttctggtatgcaatagatgcttaaaaataaatgcttattggctagccgtggtggctcatgcctgtaatcccagcacttggggaggccgaggtgggcggatcacctgaggacaggagtttgagaccagcctggccaacatggtgaaaccctgtctgtactaaaaatacaaaaattagccaggtgtggtggtgggcacctgtaatcccagctactaggggggctgaggcaggagaattgcttgaacccaggaggtggaggttgcagtgagccgagaccgcgccactgcactccagcctgggtgacagagactccatctcaaaataaataaataaataagcagcaaacaggttatacttcatatacttggagcagatgacaggaaacattggaatgggcctaaaacaaggcataaaatacaagcacttgttttactaaaacaaaaaggtactttttttgttttgccttttcctattggtgtatgggtagacgcaaaaagaatattttgtatcaacaggtgaacatggttgctttccaaaaccttaggaaatgatgacaaatgagggtgttactatttataagcttcatctttcataatttcagtccagtgggtacaaatcattggctctttgaaaggtaacctcttcgtgatataacatttattatcagtctctgagcggctacaataacaaaaatcctagaatttttgccaactatcaaatttcattgtgctaacttcctagatgcccgctgcagtacctaccattccactgggcctgttagaaaataaacagataggccaggcacagtggcttacgcctgtaatcccagcattttgggaggccgaggtgggcggatcacgaggtccagagttagatagagaccagcctgaccaacatggtgaaacctcgtctctaccaaaaatacaaaaattagctgggcgcggtggtgcgcacctgtaatcccagctactcaggaggctgaggcaggagaattgcttgaacctgggaggtggaagttgcagtgagctgagatggccccactgcactccagcctgggtgacagagcaagactctgaaaaaagaaaaaaaggaaaaaaggaaggaaggaaggaaggaaagaaggaaggaaggaaggaaagaaggaaggaaggaaggaaggaaggaaggaaggaaggaaggaaggaaggaaggaaggaaggaaggaaggaaggaaggaaggaaggaaggaaggaaggaaagaaggaagggagggagggagggagagaaagaaaagaaaagaaacataaccagctaggaagttagctcctgtgtttactcctctggggtaaaattattcacctccacttctttcaatcatctgcttctgtttttggatttgctctcatctttctcctccaagttctcacttttccttcactgaaaagttgatgacttccatgaagcctttcttgactaatagcaaataataaagggagttcgctggacccaggttccctaacactatataaaaaaatgtaccatccttctggcctgttcagaatgattgtataatatatacatatatataatatgcattttaaaatcacaggctgtttgatgttgttgtaacctcaactacatgagtccatttcagatctaaagtttttaaaaggcagggataattatatttggttgaaacaatgaattgctaactgatcatttttgacatgcaaaacagcaattgctatacattcaacataatacattgaaagttcagatgaattattacatctaatcttcacaaactgtaggaagtaggttctattatcatcctcattttttacaaaaagaactgaggtttagagagatgagtgatttaatgagagattacacagctagcaattatttttatgggtttgggttcttaaaaacatcatctgactacagagctcctatttgtaactattatactgtattgtcatttttgcttgctttttacggtactaataatgggcaatgtgcaaagggactcaataacaagcttttgaaggtgccagtacttggcaagttatctgtttattataacattataaccaacattactaaccctatttgataaatacaaaatacagcacaagagtgggaagaaatggagcacaaatagctagcattctgcctcttccatttaccgtttgaactaaatccatatatatgtgtgtatatatatgtatatatacagatcaccagaggtcaggagttcaagaccagactggccaacatggtgaaaccccatctctactaaaaatactatatacatacatacatacatacatatatatatatagtgtatatatacactaaaatatatagtatatatatgtagtgtctatatagtgtgtatatatatactaaaaatatatatatatacccccagctaatttatttttatcaagtatatatgtacacacacacacatcccactctacagatgagtagactgaggcttctgaggcttaggttaaaatatgacacaatataaccctcaaatcacatatacattttgaattagtctatagttcatgtgtgcatgtgatgtgatcctttcaataagagaaatttaaggcaaggtctgttttagaccccaccatggtgttgagaataaaaaagcctttaatacttattactttttacacttaattgatataactataaattgatagcaaatactattgatagcaagtatgtagccaatgatgattggcttatttttcagtatgtggatgaagaggacctgatgaacgccatcaaggatttcagctcagtgactaaggaacgcaccacattcacagacacccacctgtaaaggatggaaacccagaagacgtaaccctggaatgcaaggtctgcacccatttcctcctgggttatcactcacacatcataaatgctgaaaagccattgtttattatcctataattctttaaagaaatgatgactgtttttgaaagtgttccttcctaatagaggtctaagaaatgatatttttctcatcttaaatgagagagaatattcatatgaaaatacttgatttgctcttattttgtagaagacaaagaagtatgtaattgtcacttggttctgtttggcagtgatgctcctggttaactgaataatcagtggcaatttcaagatggctcacagttgttagaagtagtaagttagttactggctcaaaaatgattctgttgaaaggatgtcactgctgttcatttctatctgccatttctgtcagggttgacacaatcctgcaagaatagttattctaatgatcacagctgctaaatgaatcccaaactttgcaccaggtcgacaaacttttctgaaggttctatttatttaccatacatagggttacttaccaaactttttgacaaggctgaaggttctatttatttacaatacatagggttactcaccaaactttttgacaaggcaacacataacttacacataaatgtctctgttcttgcatttatgaattttccaaaaatctaaggagtaaacagcttatttatacattttgaggagaaaacaaagtgtttcactaggaacacctctacttgaaccaatgtttttatttcatatattttatagttttgaaactagtttctcataaaattctgtcaattcactgaatatcagagaatactgacatcttcaacctagcacatttcaaatggaaactactgttctatttgcaatattaggctgcgtgaaattttaaaaggaaaaatgtatctgttccttctagcattaacatatatacatgtagagacaagactatacctatgtgtatatatatgtatatcatgtatatattactctgcactatatcccttctttttggagaactagccattattttagccacagaatcagtaagaacagatgatatgcaacagtaccaattacggttcaaaaatgtctgtcacctgctctagttggattacaaagtcattggtgaaagtcctatggcaagaaaaattttcttgcaaatcatccacataaaatcagatatttaaatttgttcttcatggaaaacagagtaagaaaacctcttgtcttccttcatccttaaaggtctttgtgaccccaggaaaatattgactctgtctaacacacaatagtcacaatactttttgtgaatctacaaccagagacaggcaaaaacttgtaaagtaagggatagtcttacttattctgcctgaaaacaatgtattaccccagggcccaacagtaaaagattgtggactttttgggtattgagatttcatctagctctgtgagagagcagctcctcagactgaccaactcctagacaaagtttgccaaccataagtgtcaaaagcacaggccagtattaagcagaagttctaccaccttattagaactgctataaacaaaagcatctgaaataattgtgcacatctggcagtgactgtagaaaatacgaaatatatatttctcgccaagtttttatactttctgaaatgaaaacataggattgactagtttactggtttttattcccatatgccgattctgggacaataaagttgtttaaagctggcacaaataagcattaaccaaggctgtgtccaccttctgtgagctacttaaggtatataggaaaggagtggtcacaaacttgcatcctaatccttggtggactcttctaagaatacagtttgctagtcacaaagaatagtctacaaatatgctttgctaggttcagaagattgagtttatcctgatttttgaaaaattaaccaggtatctttatcactgtgtatttttccaagcacagtataaaattttaacaacgcacaaaaaaatacagaactgcaggggattttatcttggatcattatccatttaatcatctaattagacatgaactcagttagctgaatcatttacattttgactccatagcttagggcagacagaagcctgtatggcttctgcccagaactctgtcccctgctacatgtctaagtttacttgtatttatttcagagaagaactctaagatgttgctttgctactttaagtggtattgcgtgccaagcctctattatacaaaccatgcagactcgcctctagagattctgattcggttgatctggggtgtgtggctgaggcatcagtactttttaaagcttccaggtgttctaatgttgagacccactgatgttccacaatctggaagaaatcatgtacaggaataatatgctatgcacagggactatgctccttggctcaccccttctcccttataaacaatgagcagttcttgatgaacctctttaaatttaaatctcctgactcacattttaccaattgtacatgccacattctcagcttacgaactaccatgttttgttattcttaatatcaactgtttggtaagagtacagttgtttttatacactctaagaaatgtgtttataatctactgtaatttccactaaatggaacccaaatattaatgttatggtaccatatactgatgtaaaaatcatgctggcatccatgaacacaccggtaaataaaacatagtccaagtggaagaattcattaataaggaacttttaattatgtcacaaatgaatagttggtttccaatgcacaaatatcatgtaaactaatctaaagatggtttgcttaataaatatttgaatgtgacc

SEQ ID NO: 5267 - RNA, 100 nt, Artificial Sequence
  chemically synthesized
  misc_base (1)..(20): n is a, c, g, u, or other
  misc_feature (1)..(20): n is a, c, g, or u
nnnnnnnnnnnnnnnnnnnnguuuuagagcuagaaauagcaaguuaaaauaaggcuaguccguuaucaacuugaaaaaguggcaccgagucggugcuuuu

SEQ ID NO: 5268 - RNA, 96 nt, Artificial Sequence
  chemically synthesized
  misc_base (1)..(20): n is a, c, g, u, or other
  misc_feature (1)..(20): n is a, c, g, or u
nnnnnnnnnnnnnnnnnnnnguuuuagagcuagaaauagcaaguuaaaauaaggcuaguccguuaucaacuugaaaaaguggcaccgagucggugc

SEQ ID NO: 5269 - RNA, 114 nt, Artificial Sequence
  chemically synthesized
  misc_base (1)..(30): n is a, c, g, u, or other and this region may encompass 17-30 nucleotides;
  misc_feature (1)..(30): n is a, c, g, or u
  modified_base (107)..(114): This region may encompass 1-8 uracil;
nnnnnnnnnnnnnnnnnnnnnnnnnnnnnnguuuuagagcuagaaauagcaaguuaaaauaaggcuaguccguuaucaacuugaaaaaguggcaccgagucggugcuuuuuuuu

SEQ ID NO: 5270 - DNA, 23 bp, Artificial Sequence
  Description of Artificial Sequence:  Synthetic Oligonucleotide
  misc_feature (1)..(21): n is a, c, g, t, unknown, or other
nnnnnnnnnnnnnnnnnnnnnrg

SEQ ID NO: 5271 - protein, 9 aa, Unknown
  Description of Unknown: Homing endonuclease sequence
LAGLIDADG

SEQ ID NO: 5272 - RNA, 20 nt, Artificial Sequence
  Chemically Synthesized
cugagccauggagguuacac

SEQ ID NO: 5273 - RNA, 20 nt, Artificial Sequence
  Chemically Synthesized
cccugccaguguaaccucca

SEQ ID NO: 5274 - RNA, 20 nt, Artificial Sequence
  Chemically Synthesized
auuuguucacugagccaugg

SEQ ID NO: 5275 - RNA, 20 nt, Artificial Sequence
  Chemically Synthesized
aaauucugcaauccucacuc

SEQ ID NO: 5276 - RNA, 20 nt, Artificial Sequence
  Chemically Synthesized
aauucugcaauccucacucu

SEQ ID NO: 5277 - RNA, 20 nt, Artificial Sequence
  Chemically Synthesized
ggugucacacugaaguccuu

SEQ ID NO: 5278 - RNA, 20 nt, Artificial Sequence
  Chemically Synthesized
guuagaugucaccaauugua

SEQ ID NO: 5279 - RNA, 20 nt, Artificial Sequence
  Chemically Synthesized
acagucacaggccuuacaau

SEQ ID NO: 5280 - RNA, 20 nt, Artificial Sequence
  Chemically Synthesized
gacacagcuggaucccuccc

SEQ ID NO: 5281 - RNA, 20 nt, Artificial Sequence
  Chemically Synthesized
acacagcuggaucccucccu

SEQ ID NO: 5282 - RNA, 20 nt, Artificial Sequence
  Chemically Synthesized
auuacagacagucccaggga

SEQ ID NO: 5283 - RNA, 20 nt, Artificial Sequence
  Chemically Synthesized
cauuacagacagucccaggg

SEQ ID NO: 5284 - RNA, 20 nt, Artificial Sequence
  Chemically Synthesized
uagcauuacagacaguccca

SEQ ID NO: 5285 - RNA, 20 nt, Artificial Sequence
  Chemically Synthesized
uuagcauuacagacaguccc

SEQ ID NO: 5286 - RNA, 20 nt, Artificial Sequence
  Chemically Synthesized
acugucuguaaugcuaagac

SEQ ID NO: 5287 - RNA, 20 nt, Artificial Sequence
  Chemically Synthesized
cugucuguaaugcuaagaca

SEQ ID NO: 5288 - RNA, 20 nt, Artificial Sequence
  Chemically Synthesized
gcacugucucccuucaacau

SEQ ID NO: 5289 - RNA, 20 nt, Artificial Sequence
  Chemically Synthesized
ucugcaagcccaauguugaa

SEQ ID NO: 5290 - RNA, 20 nt, Artificial Sequence
  Chemically Synthesized
gagacagugcaauaaauguu

SEQ ID NO: 5291 - RNA, 20 nt, Artificial Sequence
  Chemically Synthesized
uggagggaaacuucuaccua

SEQ ID NO: 5292 - RNA, 20 nt, Artificial Sequence
  Chemically Synthesized
ccagucuuaucacaguugca

SEQ ID NO: 5293 - RNA, 20 nt, Artificial Sequence
  Chemically Synthesized
cuugcaacugugauaagacu

SEQ ID NO: 5294 - RNA, 20 nt, Artificial Sequence
  Chemically Synthesized
gauaagacugggacaauaaa

SEQ ID NO: 5295 - RNA, 20 nt, Artificial Sequence
  Chemically Synthesized
agaguaagauuggcccccua

SEQ ID NO: 5296 - RNA, 20 nt, Artificial Sequence
  Chemically Synthesized
guaaucagugugagccucac

SEQ ID NO: 5297 - RNA, 20 nt, Artificial Sequence
  Chemically Synthesized
auggucaaauuguaccugug

SEQ ID NO: 5298 - RNA, 20 nt, Artificial Sequence
  Chemically Synthesized
gcaguguugaaaauugucaa

SEQ ID NO: 5299 - RNA, 20 nt, Artificial Sequence
  Chemically Synthesized
cucacaagcaaugccauagg

SEQ ID NO: 5300 - RNA, 20 nt, Artificial Sequence
  Chemically Synthesized
ucucacaagcaaugccauag

SEQ ID NO: 5301 - RNA, 20 nt, Artificial Sequence
  Chemically Synthesized
aggaaucacacucacacauc

SEQ ID NO: 5302 - RNA, 20 nt, Artificial Sequence
  Chemically Synthesized
gaugugugagugugauuccu

SEQ ID NO: 5303 - RNA, 20 nt, Artificial Sequence
  Chemically Synthesized
ugugugagugugauuccuug

SEQ ID NO: 5304 - RNA, 20 nt, Artificial Sequence
  Chemically Synthesized
ggucccagguaaugucccca

SEQ ID NO: 5305 - RNA, 20 nt, Artificial Sequence
  Chemically Synthesized
gauuccuuggggacauuacc

SEQ ID NO: 5306 - RNA, 20 nt, Artificial Sequence
  Chemically Synthesized
auuccuuggggacauuaccu

SEQ ID NO: 5307 - RNA, 20 nt, Artificial Sequence
  Chemically Synthesized
auugggucacaaaugguccc

SEQ ID NO: 5308 - RNA, 20 nt, Artificial Sequence
  Chemically Synthesized
accauuugugacccaaucag

SEQ ID NO: 5309 - RNA, 20 nt, Artificial Sequence
  Chemically Synthesized
gauuaggcacacacaggcac

SEQ ID NO: 5310 - RNA, 20 nt, Artificial Sequence
  Chemically Synthesized
cuugacgauuaggcacacac

SEQ ID NO: 5311 - RNA, 20 nt, Artificial Sequence
  Chemically Synthesized
cugugugugccuaaucguca

SEQ ID NO: 5312 - RNA, 20 nt, Artificial Sequence
  Chemically Synthesized
agguguaaucagugucaacc

SEQ ID NO: 5313 - RNA, 20 nt, Artificial Sequence
  Chemically Synthesized
gacauuccuuuuguuaacuu

SEQ ID NO: 5314 - RNA, 20 nt, Artificial Sequence
  Chemically Synthesized
gaagccacaaaccagaaaca

SEQ ID NO: 5315 - DNA, 20 bp, Artificial Sequence
  Chemically Synthesized
ctgagccatggaggttacac

SEQ ID NO: 5316 - DNA, 20 bp, Artificial Sequence
  Chemically Synthesized
ccctgccagtgtaacctcca

SEQ ID NO: 5317 - DNA, 20 bp, Artificial Sequence
  Chemically Synthesized
atttgttcactgagccatgg

SEQ ID NO: 5318 - DNA, 20 bp, Artificial Sequence
  Chemically Synthesized
aaattctgcaatcctcactc

SEQ ID NO: 5319 - DNA, 20 bp, Artificial Sequence
  Chemically Synthesized
aattctgcaatcctcactct

SEQ ID NO: 5320 - DNA, 20 bp, Artificial Sequence
  Chemically Synthesized
ggtgtcacactgaagtcctt

SEQ ID NO: 5321 - DNA, 20 bp, Artificial Sequence
  Chemically Synthesized
gttagatgtcaccaattgta

SEQ ID NO: 5322 - DNA, 20 bp, Artificial Sequence
  Chemically Synthesized
acagtcacaggccttacaat

SEQ ID NO: 5323 - DNA, 20 bp, Artificial Sequence
  Chemically Synthesized
gacacagctggatccctccc

SEQ ID NO: 5324 - DNA, 20 bp, Artificial Sequence
  Chemically Synthesized
acacagctggatccctccct

SEQ ID NO: 5325 - DNA, 20 bp, Artificial Sequence
  Chemically Synthesized
attacagacagtcccaggga

SEQ ID NO: 5326 - DNA, 20 bp, Artificial Sequence
  Chemically Synthesized
cattacagacagtcccaggg

SEQ ID NO: 5327 - DNA, 20 bp, Artificial Sequence
  Chemically Synthesized
tagcattacagacagtccca

SEQ ID NO: 5328 - DNA, 20 bp, Artificial Sequence
  Chemically Synthesized
ttagcattacagacagtccc

SEQ ID NO: 5329 - DNA, 20 bp, Artificial Sequence
  Chemically Synthesized
actgtctgtaatgctaagac

SEQ ID NO: 5330 - DNA, 20 bp, Artificial Sequence
  Chemically Synthesized
ctgtctgtaatgctaagaca

SEQ ID NO: 5331 - DNA, 20 bp, Artificial Sequence
  Chemically Synthesized
gcactgtctcccttcaacat

SEQ ID NO: 5332 - DNA, 20 bp, Artificial Sequence
  Chemically Synthesized
tctgcaagcccaatgttgaa

SEQ ID NO: 5333 - DNA, 20 bp, Artificial Sequence
  Chemically Synthesized
gagacagtgcaataaatgtt

SEQ ID NO: 5334 - DNA, 20 bp, Artificial Sequence
  Chemically Synthesized
tggagggaaacttctaccta

SEQ ID NO: 5335 - DNA, 20 bp, Artificial Sequence
  Chemically Synthesized
ccagtcttatcacagttgca

SEQ ID NO: 5336 - DNA, 20 bp, Artificial Sequence
  Chemically Synthesized
cttgcaactgtgataagact

SEQ ID NO: 5337 - DNA, 20 bp, Artificial Sequence
  Chemically Synthesized
gataagactgggacaataaa

SEQ ID NO: 5338 - DNA, 20 bp, Artificial Sequence
  Chemically Synthesized
agagtaagattggcccccta

SEQ ID NO: 5339 - DNA, 20 bp, Artificial Sequence
  Chemically Synthesized
gtaatcagtgtgagcctcac

SEQ ID NO: 5340 - DNA, 20 bp, Artificial Sequence
  Chemically Synthesized
atggtcaaattgtacctgtg

SEQ ID NO: 5341 - DNA, 20 bp, Artificial Sequence
  Chemically Synthesized
gcagtgttgaaaattgtcaa

SEQ ID NO: 5342 - DNA, 20 bp, Artificial Sequence
  Chemically Synthesized
ctcacaagcaatgccatagg

SEQ ID NO: 5343 - DNA, 20 bp, Artificial Sequence
  Chemically Synthesized
tctcacaagcaatgccatag

SEQ ID NO: 5344 - DNA, 20 bp, Artificial Sequence
  Chemically Synthesized
aggaatcacactcacacatc

SEQ ID NO: 5345 - DNA, 20 bp, Artificial Sequence
  Chemically Synthesized
gatgtgtgagtgtgattcct

SEQ ID NO: 5346 - DNA, 20 bp, Artificial Sequence
  Chemically Synthesized
tgtgtgagtgtgattccttg

SEQ ID NO: 5347 - DNA, 20 bp, Artificial Sequence
  Chemically Synthesized
ggtcccaggtaatgtcccca

SEQ ID NO: 5348 - DNA, 20 bp, Artificial Sequence
  Chemically Synthesized
gattccttggggacattacc

SEQ ID NO: 5349 - DNA, 20 bp, Artificial Sequence
  Chemically Synthesized
attccttggggacattacct

SEQ ID NO: 5350 - DNA, 20 bp, Artificial Sequence
  Chemically Synthesized
attgggtcacaaatggtccc

SEQ ID NO: 5351 - DNA, 20 bp, Artificial Sequence
  Chemically Synthesized
accatttgtgacccaatcag

SEQ ID NO: 5352 - DNA, 20 bp, Artificial Sequence
  Chemically Synthesized
gattaggcacacacaggcac

SEQ ID NO: 5353 - DNA, 20 bp, Artificial Sequence
  Chemically Synthesized
cttgacgattaggcacacac

SEQ ID NO: 5354 - DNA, 20 bp, Artificial Sequence
  Chemically Synthesized
ctgtgtgtgcctaatcgtca

SEQ ID NO: 5355 - DNA, 20 bp, Artificial Sequence
  Chemically Synthesized
aggtgtaatcagtgtcaacc

SEQ ID NO: 5356 - DNA, 20 bp, Artificial Sequence
  Chemically Synthesized
gacattccttttgttaactt

SEQ ID NO: 5357 - DNA, 20 bp, Artificial Sequence
  Chemically Synthesized
gaagccacaaaccagaaaca

SEQ ID NO: 5358 - DNA, 20 bp, Artificial Sequence
  Chemically Synthesized
gtgtaacctccatggctcag

SEQ ID NO: 5359 - DNA, 20 bp, Artificial Sequence
  Chemically Synthesized
tggaggttacactggcaggg

SEQ ID NO: 5360 - DNA, 20 bp, Artificial Sequence
  Chemically Synthesized
ccatggctcagtgaacaaat

SEQ ID NO: 5361 - DNA, 20 bp, Artificial Sequence
  Chemically Synthesized
gagtgaggattgcagaattt

SEQ ID NO: 5362 - DNA, 20 bp, Artificial Sequence
  Chemically Synthesized
agagtgaggattgcagaatt

SEQ ID NO: 5363 - DNA, 20 bp, Artificial Sequence
  Chemically Synthesized
aaggacttcagtgtgacacc

SEQ ID NO: 5364 - DNA, 20 bp, Artificial Sequence
  Chemically Synthesized
tacaattggtgacatctaac

SEQ ID NO: 5365 - DNA, 20 bp, Artificial Sequence
  Chemically Synthesized
attgtaaggcctgtgactgt

SEQ ID NO: 5366 - DNA, 20 bp, Artificial Sequence
  Chemically Synthesized
gggagggatccagctgtgtc

SEQ ID NO: 5367 - DNA, 20 bp, Artificial Sequence
  Chemically Synthesized
agggagggatccagctgtgt

SEQ ID NO: 5368 - DNA, 20 bp, Artificial Sequence
  Chemically Synthesized
tccctgggactgtctgtaat

SEQ ID NO: 5369 - DNA, 20 bp, Artificial Sequence
  Chemically Synthesized
ccctgggactgtctgtaatg

SEQ ID NO: 5370 - DNA, 20 bp, Artificial Sequence
  Chemically Synthesized
tgggactgtctgtaatgcta

SEQ ID NO: 5371 - DNA, 20 bp, Artificial Sequence
  Chemically Synthesized
gggactgtctgtaatgctaa

SEQ ID NO: 5372 - DNA, 20 bp, Artificial Sequence
  Chemically Synthesized
gtcttagcattacagacagt

SEQ ID NO: 5373 - DNA, 20 bp, Artificial Sequence
  Chemically Synthesized
tgtcttagcattacagacag

SEQ ID NO: 5374 - DNA, 20 bp, Artificial Sequence
  Chemically Synthesized
atgttgaagggagacagtgc

SEQ ID NO: 5375 - DNA, 20 bp, Artificial Sequence
  Chemically Synthesized
ttcaacattgggcttgcaga

SEQ ID NO: 5376 - DNA, 20 bp, Artificial Sequence
  Chemically Synthesized
aacatttattgcactgtctc

SEQ ID NO: 5377 - DNA, 20 bp, Artificial Sequence
  Chemically Synthesized
taggtagaagtttccctcca

SEQ ID NO: 5378 - DNA, 20 bp, Artificial Sequence
  Chemically Synthesized
tgcaactgtgataagactgg

SEQ ID NO: 5379 - DNA, 20 bp, Artificial Sequence
  Chemically Synthesized
agtcttatcacagttgcaag

SEQ ID NO: 5380 - DNA, 20 bp, Artificial Sequence
  Chemically Synthesized
tttattgtcccagtcttatc

SEQ ID NO: 5381 - DNA, 20 bp, Artificial Sequence
  Chemically Synthesized
tagggggccaatcttactct

SEQ ID NO: 5382 - DNA, 20 bp, Artificial Sequence
  Chemically Synthesized
gtgaggctcacactgattac

SEQ ID NO: 5383 - DNA, 20 bp, Artificial Sequence
  Chemically Synthesized
cacaggtacaatttgaccat

SEQ ID NO: 5384 - DNA, 20 bp, Artificial Sequence
  Chemically Synthesized
ttgacaattttcaacactgc

SEQ ID NO: 5385 - DNA, 20 bp, Artificial Sequence
  Chemically Synthesized
cctatggcattgcttgtgag

SEQ ID NO: 5386 - DNA, 20 bp, Artificial Sequence
  Chemically Synthesized
ctatggcattgcttgtgaga

SEQ ID NO: 5387 - DNA, 20 bp, Artificial Sequence
  Chemically Synthesized
gatgtgtgagtgtgattcct

SEQ ID NO: 5388 - DNA, 20 bp, Artificial Sequence
  Chemically Synthesized
aggaatcacactcacacatc

SEQ ID NO: 5389 - DNA, 20 bp, Artificial Sequence
  Chemically Synthesized
caaggaatcacactcacaca

SEQ ID NO: 5390 - DNA, 20 bp, Artificial Sequence
  Chemically Synthesized
tggggacattacctgggacc

SEQ ID NO: 5391 - DNA, 20 bp, Artificial Sequence
  Chemically Synthesized
ggtaatgtccccaaggaatc

SEQ ID NO: 5392 - DNA, 20 bp, Artificial Sequence
  Chemically Synthesized
aggtaatgtccccaaggaat

SEQ ID NO: 5393 - DNA, 20 bp, Artificial Sequence
  Chemically Synthesized
gggaccatttgtgacccaat

SEQ ID NO: 5394 - DNA, 20 bp, Artificial Sequence
  Chemically Synthesized
ctgattgggtcacaaatggt

SEQ ID NO: 5395 - DNA, 20 bp, Artificial Sequence
  Chemically Synthesized
gtgcctgtgtgtgcctaatc

SEQ ID NO: 5396 - DNA, 20 bp, Artificial Sequence
  Chemically Synthesized
gtgtgtgcctaatcgtcaag

SEQ ID NO: 5397 - DNA, 20 bp, Artificial Sequence
  Chemically Synthesized
tgacgattaggcacacacag

SEQ ID NO: 5398 - DNA, 20 bp, Artificial Sequence
  Chemically Synthesized
ggttgacactgattacacct

SEQ ID NO: 5399 - DNA, 20 bp, Artificial Sequence
  Chemically Synthesized
aagttaacaaaaggaatgtc

SEQ ID NO: 5400 - DNA, 20 bp, Artificial Sequence
  Chemically Synthesized
tgtttctggtttgtggcttc

SEQ ID NO: 5401 - DNA, 20 bp, Artificial Sequence
  oligonucleotide primer
tccatggctcagtgaacaaa

SEQ ID NO: 5402 - DNA, 20 bp, Artificial Sequence
  oligonucleotide primer
cttcaacattgggcttgcag

SEQ ID NO: 5403 - DNA, 26 bp, Artificial Sequence
  oligonucleotide probe
acacagctggatccctccctgggact

SEQ ID NO: 5404 - DNA, 20 bp, Artificial Sequence
  oligonucleotide primer
tccagatggtagctgaggtt

SEQ ID NO: 5405 - DNA, 20 bp, Artificial Sequence
  oligonucleotide primer
gtcccagagggaaacttgac

SEQ ID NO: 5406 - DNA, 24 bp, Artificial Sequence
  oligonucleotide probe
gctgaccaccagccaaaggggcac
